United States Patent 6,833,447 (MYXOCOCCUS XANTHUS GENOME SEQUENCES AND USES THEREOF) - sequence listing, part 8

SEQ ID NO: 16309 - protein, 910 aa, Myxococcus xanthus
LSKTLLFEHRTLGELTAHLAEAFADRLAGIFGLAPSVEQREEATRPAKREPAPRVSDGGSPTDVAIIGLAGRYPGARDLNAFWRNLREGVDSIGEVPQDRWDHSAIFDPDKSRPGKTYSKWGGFIEGAAEFDPRFFNIPPKEAHFIDPQERLFLECAYACCEDAGYTRESLAKLGGDRAGGSVGVFVGVMYQEYQLYGAQETIQGRPLSLPGNASSIANRVSYWFDFHGPSMAVDTMCSSSLTALHLAMQSLANGDCEAALVGGVNLSVHPNKYLGLSQGRFVSSKGRCESFGAGGDGYVPAEGVGAVLLKPLERAKADGDRIYGVIKATAVNHGGRTAGFSVPNPNAQAQVIGRALRRAGVDARTVGYVEAHGTGTSLGDPVEIAGLQKAFSEFTSDKAFCAIGSVKSNIGHCESAAGIAGLTKVLLQMKHRQLVPSLHSQVLNPHIDFDGTAFVVQQRLTEWKSPVQEHEGRRVTQPRRAALSSFGAGGANAHVVFEEYVEEANPRATDRESQAPVVILLSATLEAGLQARARQLLDWMRDPELRQGSLDDVAHTLLNGREHMVERLAFVVSTFAELEAALEDFLAADGSQPKSKGKRVWRGRVERVSNGLTDALVDEDMQQTVDAWVAKRKFDKLLDLWTAGVSIDWSRLHGGSKPRKVSLPTYPFARERYWVPRFDERSTPEPKQHVELPPVPSLPREIPAPVTPRARIKLEPVGQVSVGNGVEARRLPPMPKVLTPTRSPEDAPPVVAEVREPARAPVQPVSEPPVPAPKRPAPVAPRTPAPAGVTLEQLQAELTVSLARALFLQPSEVDLDVGFRHIGLDSIISVEWIQSVNKSYGINVAATRVYDYPNIREFSKYLGNEIQKTVSAGAPAQGEPPSLDELLRQVEAGELDPSVAQQFLTNSQS

SEQ ID NO: 16310 - protein, 222 aa, Myxococcus xanthus
MFSSIATKYDVTNEVLSFGIHRLWRRKAVRLSTAKEGDRVLDCASGTGDLALAFKRKVGVSGRVVGTDFCPEMLESAPAKAEKAGLQVDFQVADAMDLPFAADSFDVASISFGIRNVDDPVKCLKEMARVVRPGGHVVVLEFGQPTGAFGALFRFYSKTVMPTIGGLLTGNRAAYQYLPKTSASFPAGDKFLELMDQSGAYAAKSAHALTFGTAYVYVGTVR

SEQ ID NO: 16311 - protein, 261 aa, Myxococcus xanthus
QARVAILQGLRQLATSERLPLYFYGVERDDTTLREALTSATFQEIFIYDDNVMDVPGDNFDAYLGQFKSDVRRVLKKEMAHARDTGVRFERVSRMGEMAEQLERFYEVTYSKYGNEHLRHPSTFWAALDQHVSPEAEAVVAYQNGDPIGFSLLLHKNDEMWFYRVGRAEAGASETPLYFNLAFYEPLRRAYELGVKKLWLGASGYETKRRRGARRHGLYSYLWIPGRWSRTVLQPYVSAYSRVAMAMAASGTQNGRIRKTP

SEQ ID NO: 16312 - protein, 1224 aa, Myxococcus xanthus
AARVPGAEDVEAFWRLLREGREAITFFTSEAMKALGVEPGWLANPNFVRAAPVLERPGRFDAALFGYAPREAELLDPQHRIFLECAWSALEHAGYAPGRLTVSTGVFAGSSLSTYLLFNLLSRAEFQQAEDTFPAMVGNDKDFLATRVAYHFNLKGPALTVQTGCSTSLVATHLACQSLLGYQCDVALAGGVSVHMPQRTGYHSQDGGITSPDGHCRAFDAKGQGTLFGSGAGVVVLKRLEDALNDGDTIHAVIRGSAINNDGAMKVGYTAPGVEGQSEVIARAQAVAEVSPDSISYVEAHGTATPLGDPVEVQALTEAFRAGTDKRGFCGLGSVKTNVGHLDAAAGVTGLLKTVLALEHGELPPSLHYEKPNPRIDFESSPFYVNAALKPWPEGDTPRRAGVSSFGIGGTNAHVILEEAPVSLPGDAARPLQLLVLSAKTPSALESQTAALLAHLQAHPEQQLADVAWTLQVGRKPMEIRRIVVCEDRASAVAALESKDPQRMFTLAPGNSTPSAVFMFPGGGAQYPDMGRGLYASEKVFREAVDCCCELLRPRLGFDLRPVMYPDAANAADAVQRLKRTSLALPALFTVEYALAQLWQSWGVKPEALIGHSLGEYAAACLAGVFSLEDALALVVLRGKLFEELPGGGMLSVPLPEAELRPLLGDSLSIAAMNGPAQCAVAGTVDAVEALAAELTRREVEFRHIPIDVAAHSHLVEPILARFESFVGTLTRNAPTLPIVSNVTGTWMTPEEAVDPAYWTRHLRQTVRFGDGIRTLAAQPGRVYLEVGPGRTLGTLARLQLNGPKAPSVLSSLRHPQDPVPDDAFLSTTVGRLWAAGMEVDWSAVHGGARRLRVPLPTYPFEGQDYWLAPEVSSSRRRGIARKSADVAGWFYLPAWQRAPLMPKAGPVTPRGWVVYQDVGGLGAALAERLERLGHGVIRVTPGPGFRQVTEHEFTVDGREREDHAQFLRALKARSFNVERVVYLWSLDVSGADFDEAQARGFFSVLRLAQALSGAELPGPVELTVVGREALEVESADAVAPERATLPALCKVIPQELDTVACRYVDVSTPSVDALVREVTSDAPDPVVAWRGPHRQVQAYEPLRIEADTPVSWPLKQRGVYLITGGLGGVGLRMADYLARTRQARLVLVGRSGAEQDADGRRQRAVRALEAAGAEVLVARADVADEAQLRTVLAEVDSRFGALDGVIHAAGLPADGPVSLLGAI

SEQ ID NO: 16313 - protein, 1062 aa, Myxococcus xanthus
MAGDTHWNGLEIAIIGMACRFPGACNAEAYWRNLRDGVESITFLQESELEPSVMEDPALRKSPQYVRAAAPIEGADLFDAAFFGITPKEAEVMDPQQRVFLECAWAALEDAGYDPERYREHIGVYAGARTNTYVFNLFSNPAALGMLGAFEVGLGNDLAFLSTRVAHRLNLKGPAYSLHTACSTSLVAVHLAAQALLAGECRMALAGGVALQSPQRTGYLYQFGGVASPDGRCRTFDAQAQGTLFGNGAGLVVLKRLEDALEDGDTIHAVIRGSAINNDGAQKASFNAPSVQGQSRVIRNALLTAEVDARSITYVEAHGTATQLGDPIEVQALTKAFRATTQRRRFCALGSVKGNMGHLDAAAGITGLMKTVMALKHGELPPSLHYERPNPAIDFDSSPFYVNATLKPWPAGDSPRRAGVSSFGVGGTNAHVVLEEAPRLPASAPSRRAWHLLPLSARTPSALESVTTRLVESLKKQGGVNLADVAWTLQAGRQRFLHRRFVLARSAEDAVDALSQPQCPRVFTEAQDAVERSVAFLFPGQGSQHVDMGRALYEAEPVFRVEVDRCAELLKPHLDGLDLRTVLYPQSEAAEVSGAKLAQTALTQPALFTLEYATARLWMSWGVMPQSMLGHSIGEYVAACLAGVFSLEHALRLVAARGRLMQGLPSGAMLAVPLSEDEVQPYLRAGGIELSLAALNGPMQCVLSGTHAAVEAVRKQLQEAGIQCQPLVTSHAFHSSMMDSILDAFAAQVATVPLAAPMLPFVSNVTGTWVTAEQATSPRYWAEHLRGTVRFADGLHALLTDARRVLLEVGPGQVLGKLAKRHPAFTASHAVLASTPPPKDAGATAGMAPLAYETLGRLWQAGVRVDWKGFHGAEVRYRVPLPTYPFERQRFWIEPAAVETAPRGTIASQPVTAVPDATPQASQAEPGGEAVRARSYQPRPQLRSAYVMPGTPLQRSLVELWQEMLGVAPIGIQDNFFELGGDSLIAVQLSGRIKKQLGLDLPASSLYEGVTVEALAALLKPAEAEGQERREEAPAADASLQRRKQTLARQRNLRRFDDDDDA

SEQ ID NO: 16314 - protein, 375 aa, Myxococcus xanthus
CAPFAAPRLWEPGRAHSPQADEQQRLLANVLHQTSTTPLPRLWYFPSAKKAVVVMTGDGHPGGATTQRWNQYLADSPTGCSVDDWECIRGTIYDYVGGLSATQANTYVAQGFEYALHINTGCADYTANTLDPNFFTPQLASFASAFPAVPAPVTNRTHCIAFSDWSTQPKVSRLHGIRLDTNYYYWPDYWVQDRPGMFTGSGLAMRFADLDGTPLDVYQLATQMTDESGQSYPLHIDTLLDNALGPTGYYGAFNANMHVDSQPSAGASGSAAIIASAKRDGVPVITAKQLLEWLDAREATQVSTVAFTGTVLTFNLTSPARNLSLMVPTRTTTGRTLLSVTRAGSAVTTVTRTIKGVDFAFIDGALAGTYTATYN

SEQ ID NO: 16315 - protein, 382 aa, Myxococcus xanthus
MLLAGWVPLVLLGVLAQAALERVLSVSIAPVEGVLEEVASELARRELPQDSLNEARLNLAQAELARRALVRRVPAFITALILISGAALTVAAVLLGRALTRPVRTLTEGMWAYARGDLSVRLATPEPPRDELQFLLGQFNRMGQELLSQRERLKSAEQIAAWQDVARALAHELKNPLTAMKLSLARLNRTDASTPHDTTRITEAVALLQEEVDLLMRMTQSFSTFARLPAPRFQDVPLRPLLAEVCTLYAGTSPVPVELRPGAEATLRADPDGLRRLFGNLVKNATEASSASAAPVHVTLESPQPGTVCVTVADGGSGVPTVLEGPALTRGLFSTKPGGSGLGLPISQKIVHEHGGSLRLEPAPGGGTLARVELPLTPPPSP

SEQ ID NO: 16316 - protein, 450 aa, Myxococcus xanthus
MKPGPRILIVDDDSGVLRALRGLLSDEGFTPVEARSAAEASQLLDAPEGPPAMMLLDLRMPGETGLELLARLPRPFPAPVVVLSGEASPAEAVQALRLGATDFVEKPPSPERLLTAVRNALALGSLQEERERLLDALARPGHLVGDSAGMASLRQLIARVGPSDTAILITGETGTGKERVARALHLASGRKGRLVAVNCAAIPSTLLESELFGHEKGAFSGALSRRAGRIEQAHGGTLFLDELGDMPLELQAKLLRVLETKEVERLGGSLPVPVDARVVTATHQDLARAVKEGRFRQDLYFRLNVMPLQVPPLRERPEDLLPLARAFAAEFAGPQVPLVLAPGAETSLRAYAWPGNVRELRNLIERLNLLRGEGPLTLGPELVSAPQATAAASRPSLGQKSYREHVEDFERELIRAALQEGESIAGAARLLQVDRGNLYRRIKALGLPVT

SEQ ID NO: 16317 - protein, 815 aa, Myxococcus xanthus
MNRFALLICLLPALAVAQPAPAPEPRSDAPSSAEAAPSQGETGNNPQSERAEGATTATDNQEAGGKPRSPTTDARGDTPADTQKSCPDDFEDDDSGDTSVLAPLQLAVDGRSLTPGRIELHGLHWLTDAQVRAFIGAPRADSGALLSGSEVHLFLRRLARSGLFARVEPRVRVAEAPQPAVLEVHLEENPVVSAVEVNGLQDLQATEILEELLRLPYRFPTEDEDEESFTATLRVDSRRGTLSVVRPCPPRYPPRDWVARLERGTLHPGIFLGGVAHGLERTLKRLRDDGYMLASLSAVLSPDGKLMVTVDEGRLESIEVRGVDADIAARVQDALDLKPGTVFLRSDAKRAVRRLTSRLPFLEPADADDSDSPRAQRANIIETREPDGTRAYHTQEAPRAKPRHREQVEFELNWKQFADWWDDVDSADSITLEGKKLVVHLRTRRPDFDVDLLPMHTQVTGFSPGLAGRLRLWDAKDRAHVTVDAALTIPLRWGGQYLPDDPEGTQRQRRINMLGGAKLQVPRVGLAELGAQVYDFTDTLDRWRMGDIDSSLYSALINRPDRDYFRRKGLTAFATWRWADDWLAGVEYRNDRYESMRSFTPPFSLFRNDSAPFPNAPVTEGRFDSVVVRMEYASNVPAAASVGSLFRTPETSLFDRDGDWESRASLRGLLTLEVGNGPGSAGGDARFWKLVSDIAMEVPTGWDTGLSLRVRTAGGHRLPEQKREALGGWTALRGFGFKEYRGDVSVLTSAEYRWSALGVFVDLGTVRADDAWTDARLGLGASLHFGDNVRMDVAWRTDERATATPEARLLFQRTF

SEQ ID NO: 16318 - protein, 157 aa, Myxococcus xanthus
MVRSEAFDFVSPELDRLVRLGMAGKLEVELTLWQRNTVWFDARMDTARLTQVLAFSKGAYVLDGRPLPEGPSSLTLERVAWTLEKRPEPGARYEVRISVRLHVVTAASLGRVAAWLTQGKQAPGEEGTTLTGTVLLRSVAEDLARGASARCDVTRPP

SEQ ID NO: 16319 - protein, 105 aa, Myxococcus xanthus
MRRWLSLLFALAAGCAPAPAPPESPDRGVQVFAPPGIEARGSRVPVLYVEEESALYFPQGVGGGGSRHPVVPSPAELLALGRRTDIIIVTVAPGHSTTSAAIAAP

SEQ ID NO: 16320 - protein, 542 aa, Myxococcus xanthus
LRQRLPGARIGYFHHIPFPSSEIFSTLPRRRELLKGLLGADLIGFHTVSYVRHFSGALLRHLGLDTDIDRIIWEGRDVRVGAFPMGIDAQAFESIASEPGMQEEVANLRRSSEGQRILLGIDRLDYTKGIPRRLLAVQRVLERTPAWRGRLRFIQVTVPSRTQVEAYANYRELVNELVGRINGLYGTVHNVPVHYLYRSFNEGKLVGLSRGANVMLVTPVRDGMNLVAKEFCTARPDDDGVLVLSEFAGAAAELGGALIVNPYDVDAMADAIEKALGMAEEERRTRMHTLRKQVKSRDVHWWTSSFLDRLQSLPAVDVRAEASAPEALAQMKQVERLQLLLDYDGTLVGYAPRPELAAPDAALKELLAKLVARPGISVSIVSGRPKETLEEWLGDLAMGLYAEHGLWSRPAPGEAWRMLEGVTFDWKERVRPELETFSARVPGSFVEEKTASLAWHYRLVDAEFGAIQSRELRLYLAEKFAGQSMDILPGDKVVEIRPRGVHKGRVVGEATKDAAPGALVVAIGDDRTDEDLFASIPPGGLT

SEQ ID NO: 16321 - protein, 138 aa, Myxococcus xanthus
MVARMLARPGLDLDAHLERLHGRPLRRWVAEAPQEFRAAERRALQGLPAGGLVAVGGGFLSHHPDALTGLFTLVVPICFDTYRERLLTDRTRPRLRADMSLEEELSAVFHEREVLHARVPTVALEDFLRGCLAPEVPL

SEQ ID NO: 16322 - protein, 71 aa, Myxococcus xanthus
MTLPPDVLSLVVPLLALPQATHYVLDAFVWKPGRQPALLSRLGWTPMATRHEGPTSGMKPVSTMAIPARSD

SEQ ID NO: 16323 - protein, 217 aa, Myxococcus xanthus
  unsure (1)..(217): unsure at all Xaa locations
ALRPSSVVSLITPGRELFTVERPQISRERERYVYRPNTSPAPENVAVHVLNRAHAITARVEVEDGVXGVLLCHGGLTGGYSLFVKDGKLHYVYNFVGEREFHVESSVDVPKGHAELRFEFQPTGAPDLPAGRGAPGRGRLFINGDLVAQSDISETMPLLISLGEGLTCGRDENSPVSQRYQPPFAFKGGTLTEVVVDVSGEHVHDAATEANTVMARQ

SEQ ID NO: 16324 - protein, 592 aa, Myxococcus xanthus
MPGPLYDEALGVSAALGWFRLETLLWVTVLAGLTCALLDLGTGRLRRAGLRRATLAALVLPLAAIAFMEARGPALGLRMTDAWLTRELGGLRETEHFVFHYWQGKPREDVDRFARDLEFRWAQTRHFLGVAPTEPIHVWLYRDEHEKQRLVGAGRTQFAKPWRHELHIQDRPFPHSVLHHELAHVMAAPAGSGPFRVTTRLGVWPLMGVIEGFAVAADGPVQGDLTLHQWAAGMRRQKLAPDMRKLMGPQGFYQSAPARAYTVAGSFLRYLADTYGADRLRAVYAHADFNAAYGRPLGELVTEWEQYVDALPLDEASVARAFARFRTGSLFTRACAREVARLSDSARQALASDPEDALKRYRRAGELQPEEPGFRIGEAVALSQLERYADADAVLAEVGERMKGQAVLEAEVAMARADVALRRDQPGEARRFLDTVLSKDAGPELTRTAQVKLAAMEDAVRQAPIEAYFRAGQDEVRLLILARALAAVPTDPFLNYLMGRRLQQVGSPVLATGYLQQALAAEGLPEALRREALRMRVESAYLAGDCGAVRHEVGALPDFGAAFRASADEWRERCDFEEKTFRGLLVPRQAFR

SEQ ID NO: 16325 - protein, 175 aa, Myxococcus xanthus
MRFESRHRIQGTVDEVERALLDERYFEFLLKHHGVLLELQPLEVKPDGDVVRRRVRYRPKPVIEKIGPKTVPPEWFAFIETSTYDKRRKELTFENIPTSNKISKMLVNTGTMRFRDVGGGQTERVMDGEIALKLPFLLKPLGLIAEKVIQSEGLKILDNEVPVLNRFIAEVIRPG

SEQ ID NO: 16326 - protein, 155 aa, Myxococcus xanthus
MLKRFLAFSVLSLLAACAPKRIPGTDIVDNSDTRAILAVMEEYRTALEARDAQAIQKLVSPSFQDDGGTPNDPSDDLTAQNLVPYLERVFPRIQGPRIELNIRRIQVGDGVAAAIYYWNASWRMPSLHSRPMKESELEQMVLRKEDGTWKILTGI

SEQ ID NO: 16327 - protein, 526 aa, Myxococcus xanthus
MGTEGRKDWQRRESLTSALVQVGVVAVLLAGAVVFFVHRGTVRKQTEEHLRAARTAAMRGNPADLARAMTELDALFQLDAEARDAQALAADIQTVLWLEHRQPGADAKAREHLSRAAQLESQSGERYGAHALHLLAAGKSAEAEQYLAGLEARGANNARLTLARALALQARGDLPGARQAFARAAEASWRDPRFTTAYGEALMDEGQYPQAVEAFAKATSVNPDHLLARVSTALAHTYQGRKMEEAQQVLSGVEARGAELTPGLKARAGALKAELALARGAPDEALSAADEALKAVPDEHYALFARARALAVKHDVQARAAFEAAVARRRNAPLLYLDGARALQTAGDTDGAVALLDAYEATFGPVQTTTPDGKKAGLLEKDSRYWLARGGVLEAASRQDDALVAYDKALAARGVELAQAQYAKGALLLARKDYEGARPLLAAVAPDSGAGTMAEAYTAMGDLLFAQGEHAAGCQHYFFGLARERAQGTPREALAERVEDIRKRLESAGQASMAKAWKAESSSLLE

SEQ ID NO: 16328 - protein, 185 aa, Myxococcus xanthus
MKHGLRWMVVAVPLLASACQQEAQGSAPRATPKAAEPRPRITDVTAEDYVMQPLPRGHVRLEDAFGGARRVEVEIAATAGTRARGMMWRKELAEGKGMLFLFPHEEVQGFWMRNTLIPLDMIFITSDLRVAGIVSRAVPRSLESRSVGVPSQYVLEVPGGWTEKLGIRKGSTVRFEGVAGLDIEP

SEQ ID NO: 16329 - protein, 132 aa, Myxococcus xanthus
MSEQKTGPEHRQNGRAPIELKVDYKKLNSFFADYTKNISKGGTFIKTKKPLPIGTRFLFKLTVPHREAPFELLGEVVWSKADADEPGMGIRFIYSSEAQRVEFETVVEGLMSDSLGGELTEKLLNKPLHSHS

SEQ ID NO: 16330 - protein, 127 aa, Myxococcus xanthus
MDNVKWLGDRVGAFFDFEMACREDYGLDVAITLNAWCFDGGQYLPELCRAFIRGYVDVRPLSAVERTNLFGHALYGAVRFTASRIRDYHLSPLPADKLVRKDYRTYLNRARALNAMGPEGFAALLGL

SEQ ID NO: 16331 - protein, 166 aa, Myxococcus xanthus
MVNVTRSQVVGGVLALLAAGAVLYFWPRQQLTVEEAIRRQVVVMTRAAEAKDVGGVMEHVSERFRSNGQGGWSKKDVRGILTAQVLRGQWVRVFVTNLEVREVSPSEGEFQARFIFGRSQAEKVEHLAADSVLNAYLIEGAFEKEEDGEWRVVRARPESISPTDLL

SEQ ID NO: 16332 - protein, 342 aa, Myxococcus xanthus
MDASGQQASLAAPPGKLLASHHASRQLSTEEALQLWERELPADALVKHVEPMTDPAHLVTLMETQRRMVERFGATRVTVLGMGAVALPTRALLAQNNVLDYVAAGGAWVAAPGQRLLDDAVRALRGADRYTVPPPLRLGILGTSIVHLRSPRIHRQPFDRIDLPEDGPVEPVVDALLPHYGGFAVTSPFKLRLAKHTGSSLDAINTLVRRGGRWEAFNTDTFGARTVLERLGAREVFVLGDGGATSALRSVAAELSCDLRVLRRADIQAPLTGAGVWTWPDRVPAPDDLRFDGARVAVIAYGAPGRRIAAEIVQRGGTPVLLGAAWFIAQARRQRQLWESAT

SEQ ID NO: 16333 - protein, 443 aa, Myxococcus xanthus
MNESSLRELGMDLIEERQFERALAVFAEAVRRVPADHRSRMLAARCLAELGERERAVTAYHACAEGLLRRDYLLSAMAACKLALDLAPNERRLKETLFRVHSRAVRNAPGRAVVPPPLPPETLYDGKVETDLMGLQGEELSSRAIEVLAATDPGGAADPNSRPPLPLFAELDRDAFVDLVRLMAWRRVKPEEAVSREGEPADSLYVLVAGKAEVTRQMEGEARTLGFLGGGSIFGEIALLTGAPPTATVSAVSDTEVFEIRREHLNAVAKSHPAVPQVLADFAQQRMARNLMATSPMFQTMPESERGALLRRFTFRALQAREKVLVEGEHSPGLFLVLAGELVVQKEDPAGGVVTLGMLREGEVAGEISLLTGLRATATVAAARKTAAAFLERAAFHELVTAVPDIRTYLEQLSDRRLKQIGEALRPAEIIDADELVLEPEAA

SEQ ID NO: 16334 - protein, 595 aa, Myxococcus xanthus
MHVLDGPDKGRKKRFQSVRMVVGRNKDCDFVLEDQSVSRRHLELVYGQAGVVMRDLGSVSGTQVNDQRVDECLLKHGDEISMGKTRLRFVDESEQIKELRAQAEVREAAEKREREAAAREAEEKRKNQAAARGSEVDPNDPRFNEATNANYKLPDSLKENSGSKGAVAVPRPRPPIRSTPTRSNSGGLTGKQKALIGGGGALVVVLVIGLMLIPSGPPPPPSPDPKVEKAKVLMQQARESVRADDFANAVRLVGEAEKLVPGIDADNLARGARTQLEVMTALDAVRTLIEEKQFDEARAKLEATPQGTAKTDDIRRKLATELEEKDIAWRLQQVEESFASRDPETIRPLIAQLPPLNRPAYEVKLTDLEAELAKEAQDASRRTRNANARAAEVAKEKRKEFIAEAFTDVERRFNGGDYQRAVLECDRVMDKYRADKDVKDRALALKRLIPQFRRALEDGQKKLDSNSLEAGAKPLRRAAELYRQIGFRGSLGNTIDEQLASSSLAAGQSALKKGDLGAAGSHFREALRLNPGDGRAREGLENLQKKAEELFLRAYIQRDRDPKAAAEMFKVVIETASEGSDVKRKAEMYLSELQP

SEQ ID NO: 16335 - protein, 285 aa, Myxococcus xanthus
MRNLIRGVSRIGRGDYNAQLGVRGDDEVAVLAREFDQMARSLQAREAQLKAQAEALMRAEQLAAVGRISAQIVHEVRNPLSSIGLNVELLQDGFETARFATPEDAAEVKDLISAVTQEVDRLADVTEQYLRMARPPRPDLDPRDVTAVLDTVLDFTREELERAGVEVVRDFALDTPHVLADEGQLRQVFLNLLRNSREAMPSGGRLTIVTRPAEDAVEVTVRDTGQGMTEDIRQRLFEPFFTTKEGGTGLGLAVSQQILQVHGGSLSCQSIPGQGTAFVLRLPRA

SEQ ID NO: 16336 - protein, 443 aa, Myxococcus xanthus
MSFTTYRDVLPSGLRVVTIETPHLHTALLAVYVRTGSRHETLVSNGVSHYLEHLFFRGSEGWPDTVKMNAAVEEVGGNLNGVTTRDHGYYYTPIHPAHLRVGLDIIGDMLTRPRLTDMEVERQIILEEMLDEVDEKGRDIDLDNLSKHLLFPGHPLALKIAGTRESVTNMTHTQILEHFAQHYVAGNIVVTAAGRVKHSEVLEMTERAFARLPRGPSSVEAPPPLTPPGPRLHFVSHDESQTEFRLNFRGVPEQHEDYPALQIIRRVLDDGLSSRLPFEIVEKRGLAYSVSASLDAYHDAGLLEIEAASAPEKAATVITEAFRVLSTLCENEVGEEELARAKRRHRMLLEFSQDSPGELSGWFGGTELFRTPESFGHRADLVDSQSAARVREVARRYFNRENLTVVAVGQRKGLKALERVVADAPGLPGPEAAPRAVVSGGRG

SEQ ID NO: 16337 - protein, 37 aa, Myxococcus xanthus
MERLSGRRVSMLQSDEFELLTALPGVRDALEVFDEAA

SEQ ID NO: 16338 - protein, 92 aa, Myxococcus xanthus
MGLLSVDARKEERLHTRLRATFKPGVREALELTLRLTRDDAFHIAAMGPSAFHASTEELRRRADVLPELLTVSASFTVASYHRVERNGSAPA

SEQ ID NO: 16339 - protein, 367 aa, Myxococcus xanthus
MAQAHRMAGNEGAAILALKQAASMLPGSDPTIQRQLADIYLQQGLTKDALAALITMRDAGNLPDADVLRLARIQAREGMIDAAFKTLENILRENPDDAEAKSVEAEVLWLKGDELLAANLMDRLLNQDPALASARLLRARYFLVSGFPDLAESDLNAVKGADAERPEVVTLRARVLLALGRAADAEEALRGLVEAQPQNADALAWLAETVRVQGRRADAQSLVDQALQLNPRLARAQYVRGRSLEEQGDRRGAEEAYRFALSAEPRFAPVHARMWRIHLNADRITDAETSLELLLSMSEATIEEKAQLAALYARMQTKVTQGLKLIDEALKREPENPDYLRTQKALNALLPKPKKKSSGPIIIRGRR

SEQ ID NO: 16340 - protein, 89 aa, Myxococcus xanthus
MCYPVGDFRVGQRDVFLGEVEGCPVYIGGAQFEYWQHTHLTLDVVKGRGAGFSLESPLGVRFLTRSRVFTDEEYERVKNAPPPRRGPPE

SEQ ID NO: 16341 - protein, 337 aa, Myxococcus xanthus
MAAWKLAPALAAGNCVVLKPAEQTPSSILLWTELIQDLLPEGVLNVVNGFGVEAGKPLASSPRIAKVAFTGETSTGRLIMQYASENLIPVTLELGGKSPNIFFEDVMAQDDDFFDKSLEGFAMFALNQGEVCTCPSRSLISERIYSQFMEKALDRVRKVKPGNPLDTDTMVGAQASNDQLEKILSYIDIGKKEGAKVLIGGERVALSGDLKDGYYVAPTVFQGHNRMRVFQEEIFGPVVSVATFKDFDDAIRQANDTLYGLGAGVWTRDGNTAYRAGRAIEAGRVWTNCYHIYPAHAAFGGYKQSGIGRENHRKMLDHYQQTKNLLVSYSPKAMGFF

SEQ ID NO: 16342 - protein, 672 aa, Myxococcus xanthus
ELRSILPRWQRSRSLGAPSTGQPDEGPRVGSLALVERRARLEPVWHELGGMLEMLSAAPLPSGRVALLADREGVILATRSSGGDFTHHADYVRLVEGACWDETSRGTNAIGTALAESSAVAVVGPAHYAQRHHGLVCYAAPVHDPFGELVAVLDVTGPAGAADPLVLVAVASVAHAAEARLREVAWARVAAAARGGLESRLSREDGPVLVVEPMGRVSRFNAAARALLGGQGPMAVEAALGVSWRVLTDAAFRGAALETRLASQGPAWRIHAEAVGTGDASSALAVLVRLESSGVRSLGMTPGSADSRPTVAEPSTEGRGPRALSRDLWGADTVVPPGPWAALKGNDPQHRATLREAERFAPTSLPVLLLSETGTGKELLARALHSASTVATGPFVAVNCGALSPALLESELFGHAPGAFTGARVGGAEGKLAAADGGTLFLDELAEMPPALQVLLLRVLEDGAYSRVGESRVRRSRFRLVGATCRDLDAAVRNGTFRSDLYFRLQGAVLRLPPLRERNDLPELAHALLRRLSEEESLATSSISAAALTRLAAHPWPGNVRELKTVLRLALVRAGGAPVLDVDALPSGLGSPLSPGAQGEPRPAVPPVSSPPSQPSAGAAGGPLRELEARAIQEALALSGGNVAQAARRLGIARSTLYRMAERFGITLPSRA

SEQ ID NO: 16343 - protein, 339 aa, Myxococcus xanthus
MNTFGELFRLTTFGESHGPALGAILDGCPAGVPLTREQIQVALDRRRPGQSTITTARSEPDQVELLSGVFEDKTLGTPIAAIVRNTNQRSGDYEKLKAEDRPGHADAVWRERFKHRDHRGGGRTSGRETLCRVIGGAIAEAYLARDVPSIRTVAYVSQVGNLVAAVPAPGLTREQVDAHATRCPDVAIRDEMSRRILTAKEAGDSLGGAIDVRVEGLPVGLGEPIFGKLKARIAQALGSIGAVTGVVWGPPDLLERIGQPGIQFHAVKDAYGGIQGGLANGEPMQIRTFFKPPATLQEHAKGGRHDPCIMPRAVPVLEAMVSLVIADLVLHFNARPHAP

SEQ ID NO: 16344 - protein, 196 aa, Myxococcus xanthus
MTMNPAFVSILMLLALVGCTNHRQTLLERTSSYVVYDMPARQVMKAAETILSERGYALLPSTDPMFLITPWKVSGNYDVFTHWSRVYVEGHKRPDGRFTVRAYHMAANMPARTQSLPTPETTTMTAPEEKQNIMPTVLLSTEPVLVRSARPNLRRDLNLEWAIMEQLDPDFAGRVKTQVDVYLAHSSSKRPGDVLE

SEQ ID NO: 16345 - protein, 308 aa, Myxococcus xanthus
MKDAPPPAEAAPAAAAEPPVDPSKVVLRWKIAQGAPSSYRLDIERTGGAPASTEEAAPPKSAKGKGKEKPAPVAAAPAVLPGPVTYFMERTDSGDYRLRVVPVGSNVDADTATLSERGFVLDGLQGATRNTATLVLELPRDPVGTGDVWSLGTELILMEALGPQFQAGQPERSNRVKLASLTPADGGEQVATLEYAISEKLAGKVRAKDEPPTSPARAEEEDAEADDSGRPRPRAAPETSASAEVSITGRGEFLVKAGRWRSWEGTVTSVTKGGFPTAALQVPTGALKLRLTAVESAPAPTPTAQPQQ

SEQ ID NO: 16346 - protein, 737 aa, Myxococcus xanthus
SEPPEKPVTPLFDTTRDALAWLRAQGLEHLSRLSLAVLMPLVEAAWLPQARPVLARRRLVELLSTDSLARWMTEAMPSPRMKELLPTLAWRFVEAERLGAEASRASLDERLAPPAESRTHRVHGLLLALRARVPASVAPRPMHALVPDLMQYDAPLPGFRLRETRISELPVGAHAGFILPEARLIFAPTEVTGDCSCGATFCVHLLAAIDTALQWLRQPWSESFGEELEELVRPGWERALRALERAVDDSPGGPGGGEVSWRLDVINGYGVELAAYVHKRNKKGQRSTGAKVSRRKLLQDHGSQLSAADARLAALLPESEAPASRALLFELVGHPRIHLDENPDLLVRIERVKVGLVAEDRDGVVIVSAGVDGAMLPTAMLERVRKAQPEEGLYIWDDSQRVLTVLDAGPEVRALLTALNRHGNSFPPESHVALLDQLSKLSLRVPVALPRSVLGESVPLRYAPVVRMEAHASGAVRVELRTRPLPDSPTFIPGEGARDVHVRRGTGAVHAVRDFVQERDAAELLQARLPLDTAEPEELPFTFRFTSAQGGLAVLAACVELEPKPELEWVGAPVRLFHAAAPPALKVILERKRDWFGVLGGLSVEGERVELARLLDAARRKERFVQVDSTSYVEIEGALREHLERLADHAHATRHGLEVGPSAVETLTALQDAGAEVEADNTWQSLVERIFAAKELKPRVPTGLKTARRDYQLEGFPCLTRLSSWGSGGVLTLHRRA

SEQ ID NO: 16347 - protein, 364 aa, Myxococcus xanthus
MPTPTSKRGLLLVNLGTPDAPQTGPVRRYLREFLNDPRVIDIHPLGRWALLNFIILPMRPAKSAEAYRKIWMKEGSPLLVYSQALAAQVAERLAGEYEVVLAMRYGSPSIPDGIAALKARGVSEFTVLPLYPQEAASSTASSLARTYEVLAQSWDVPFVRAVPAFFEHPGFLDAFTAVARPVIDDARADYVLFSFHGLPERHMRKSDPTGTHCLSTASCCDAMTDANRHCYRAQSYATARGLAQRLGLPAEGWSVSFQSRLGRTPWVKPYTDVVLPELAKKGVKRLAVMCPAFVADCLETLEEIGLRAREQFLEAGGESLTLVPSLNAHPAWVDAVVRMVRESDGPPTAVAGPLASAREPIPPR

SEQ ID NO: 16348 - protein, 39 aa, Myxococcus xanthus
MLRTPFGTMRGTYDMVRPDGTHFEARIAEFALTLPNSLH

SEQ ID NO: 16349 - protein, 203 aa, Myxococcus xanthus
MRAGLIIAGTALVKQFHWLIYLFGAFLVFTAVKMLVSKDEEMDPEQQGIVKFARRVLPVARLGEGSRFMVQEDGRSKFTPLFIVLLVVEATDLLFALDSIPAVLGISQDAFIIYTSNVCAILGLRSLFFVVASLMEKFHFLKVGLSAILGFVGVKMLITFFDIHVPIGISLGVIAGVLVAAIVASLVWPKQPEPGQDRESAKT

SEQ ID NO: 16350 - protein, 713 aa, Myxococcus xanthus
MRRAEVLPGKPYPLGATFDGQGVNFAVFSEHAKKVEVCLFDPEDPAKETRRFPLLETTHQVWHGYVPGLAAGALYGLRVHGPYEPKKGLRFNPHKLLVDPYARAIHGQVDYQAPIYAYTPGTKEDDLAFDTRDDAAAVPKGVVMGADTFDWEGDTPPGVPWHDTLIYEVHVKGFTQLHPRVPEALRGTYAGLAHPASIEHLKKVGVTAVELLPIQHIVDEPFLIQREKVNYWGYNTLGFFAPDARYSGSGSLGGQVDEFKRMVKQLHRAGIEVLLDVVYNHTCEGNQLGPTLSFKGVDNAAYYRLTEKDPRYYLDVTGCGNSWNATHPYALKLVADSLRYWVEEMHVDGFRFDLATTLGRDRHGYDTRAAFFQIIHQDPVLSRVKLISEPWDVGDFGYQVGNFPVLWSEWNGKYRDTIRRYWKGDDRQAAEIGYRLTGSSDLFSLSGRKPAASVNFVTAHDGFTLHDLVTYNDKHNEANGEENRDGANDNHSWNCGVEGETTDAEINALREQQKRNFLATLFLSQGVPMLVAGDEMGRTQKGNNNAYCQDNELSWVDWELNDTQRALLDFTCALTKLRREQPVLHKRRFFRGAHMWDSELKDLAWFRPDGQEMRKDDWEKPYVRSLGFLLGGDAITAPDDEGNRIVGDTILVLMNAHHEPITFRLPAVEWGADWELVVDTALAGESLRTHTPAGGTVQVVGRSLAVLRRPATE

SEQ ID NO: 16351 - protein, 86 aa, Myxococcus xanthus
AREHGDTVLVACAPRYTLSALQSPEGLAGAYGSTFLDLPEAYAGMMFRDVFTGCQVRPERGPGGAVLPLGPLLAEFPVILLERSAG

SEQ ID NO: 16352 - protein, 279 aa, Myxococcus xanthus
MLYLGAAALSVVLAARDTAWTDWLARAPLYLIAAASLHGISLFTHEAVHGGLARRPWLNRLGGIACALPVLQNYAAYKVLHLKHHADLGGGKDPDHYANYTGRRWLELLMHVGRLLLGYPAYITMIPILGWRQGTTAERRWVLFEVALAVAGLTAAVIFIPGQVLLHAWAIPMLLLNTLVNVRGMSQHTFLPESTHPVRGSRTILSNPVTRFFMCNENYHLEHHLYPRVPWYNLPELHRTLRADLVAQGAPFIPSYFSFVRGVLSGSLIRGAKPATPDA

SEQ ID NO: 16353 - protein, 296 aa, Myxococcus xanthus
MPERLYPHEVLLAAFGIVLSTALVFVAGISATVTAQAVGGTVLFMGSVALLARLDAVAHVFRARLLLAYLATFFFYASVKQAVPALGLVTRDAWLLSADVFLFGITPAAWLQRWSTPWVNELFSASYLAFHGYLHLAMAWALVGPRARAERFFIDVFSAYLPGIAGYYLMPAIGPVAAWPELFTVPIEGGWFTQLNAAVVASGSSTYDLFPSLHTYITLVLLEHDRRQHPWRFRLMVPVAVAILMSTLVLRYHYAVDLLAGAVWFMVFRACFPRLQARWEARTALSKHEAPTVGVG

SEQ ID NO: 16354 - protein, 221 aa, Myxococcus xanthus
MTVRGRVVKNPAGVFHYADEGWVCPEFFDTLSDAQRREGALEAWKMVVSLDAPLFRRYVRKPPALEKLVKDARALKERICAQDPYEHTGLRRVLNFGHTFGHVLESVSRFKLSHGDGVGLGMLLALDVGRHLGVTPEPVAAEVEAALANGPGVQGRERAAALLRRAPMKDVRALLTADKKAGAKGELRMVLLTAIGATEVRDVDESSWRALWPAWTKGERP

SEQ ID NO: 16355 - protein, 70 aa, Myxococcus xanthus
MNWAGYTYRNAAENVAAGYSTALAVVNGWMTSTGHCNNIMNPALLEIGVGYFNAPNSTYRHYWTQAFGRQ

SEQ ID NO: 16356 - protein, 196 aa, Myxococcus xanthus
MRGRALIQGARPASFVMDFLLLFVGLIKVVFGGLVAALGIWLALRGLSRILGANPVEELRQGNVAACLVHAASLVSLGLLVQHAVQATSDALDLTVQNPPLHLLVVGRLVAVAVLHVGLSLGVGVTVLGTGVLLFDRMTPGIDELAEVRKGNVAAALILSAILLVLALLTAPGLQAALNGLIPFPQLLKGTLRAPA

SEQ ID NO: 16357 - protein, 161 aa, Myxococcus xanthus
MRCIYEELMRTNAEPVRRLGDTFVASIRERRLDAAQATQLILGFVQSIDYELPEHEAFGIVPPALVPAENRGDCDSKAVLAVMLLRQAGVDAVVLYSDPLSHAAVGVGLPGKGTALRYAGRSYQYAEVTAQGWPLGMIPPQYDKPRLWKVLPLNGGPDTAG

SEQ ID NO: 16358 - protein, 120 aa, Myxococcus xanthus
MGAPSLIRNLKLRQHIAGLKAEWNALDAPYLRALRDGTFAREDFVETQLQFSSAVAHFSRPMAMLASRLPRPHQRLPLVENIFDEHGRGTLAHGHERTFHLLLSRLGVETARVERHVTWP

SEQ ID NO: 16359 - protein, 306 aa, Myxococcus xanthus
MSDVRFIVARPDSLGPYVERLRLLEREILYPLADGADHFFIDHGPGYHPFFSSMGEAYFLLALRGDDLLGSVTGVLRPVWHGTRKVDALYICDLKLAKHARGSGLSTKLLLQGLKHLFLIPPLRRIRFLYGAAMRGARGDVMRIARGWNPLRMGRPASQLALYFVPPARLQAVDTRSAPPRPTGAGLRLGPAPARTLEGAGWCTTAGAKDLQRLSTGRPWPLVHLAAPPEAWTQGWGEYLRTCGVELAALGEEALACFSIDERLEDHVHWLREVGIAPDSVCTVYSLDLSFPARAPAWVHLPSSEI

SEQ ID NO: 16360 - protein, 329 aa, Myxococcus xanthus
MEPGLVSTPPLRLKFAVVREDAALELALVERTRARAVLTVASGGCTLLTLARRHPALELVGFDFNPRQLAHVREKAEGLGRLPLARYSVDAEDAAALNQRGEFEGLFRTLRRFIEEFVAPAHELAAFFAPATTASQRREACARWFASPYWPVAFELALAAPLLNTMFGPAATQHAEPGSYPGYFQAVFERGLQREDAPRNPFLQHVLLGRYLREDAPEYLRAEGPLALTLVQGSLPDVPRLDRFDVISLSNIFDWSEDALVAEWAGVLAREARPGCAVLIRQLNNRRDLRGFFQPAFEFDDALGAELLARDRSLFYERIEVGFRVPDSP

SEQ ID NO: 16361 - protein, 235 aa, Myxococcus xanthus
MLPGAWVVLRVDGRGFSRFTEARYEKPFDPVFHQFMVRTASVMLEELQGVYAYTQSDEISVLFRPDWALFDRSVEKVVSLAAGLASATFTHAAGVPAVFDGRAWLGASERAVLDYFIWRQADGSRCSLHGWCYWTLRKEGRSAAQATRELDGKPVSYKNELLFQRGINFNDVPLWQRRGSGVWWEAYQKEGVDPRDGRRTQTLRRRLKVDSELPMKEAYEHLVRGLLAAPGAEAD

SEQ ID NO: 16362 - protein, 655 aa, Myxococcus xanthus
MTPSLLLIEDPGASRELQVLSLESQGWRVWASADVPGALTLLQTQSVQVVVAAAGLLISDGTHLESLRHALSLAGALLQISAFPAEREALRPLGLSVERYLSRPLSLGALVEGVRQAFPVEAAGGPEARRPRVLVADDDPVSRKLAQLHLAPFRFEVVLAADGATALDLARRRGPDVVLADVLMPGMDGFTLCLGFRQDPRLARVPVILTHTIAPDELDLRMAHNVGANGFVRRTQEGDELVGALLRELRAGGPSHTSPPADLSTEDHLYRMVRQLERRVGLLEQAERTARESEARYRLVVSGSYDGIWDWDLRGQAFYWSPPLLDMLGLGPGDFGGTFSAFLELIHPEDRPEVMAALSAHLERGTPYDVTLRLRHVTGTWRSCVSRGRALRDAQGRPVRMAGIIGDVTEQLRLYRETQEAVRARDDFLSVAAHELRTPLAALRLRVQGAQGVLRAGLSSGTERLERALDSADRQVQRLSDLVESLLDVSQLQGGAPRLHLEDVDLALVVREAVSRSEDAAARAGCLLVLSPLEPTPGRWDAARLSQVMTHLLSNAMKFGPGKPVEVALESGRDVATLMVKDHGIGIAPGRLESLFRRFERAVPVRHYGGLGLGLYRLRRIVEAHGGGVSVDSTPGAGATFRVRLPREGPPAVRG

SEQ ID NO: 16363 - protein, 150 aa, Myxococcus xanthus
STAKASRIVVDPSALHAAPLTPPVSKSDAQRALVLGHLTGSWPLPSVQAEADEDLPADVRVLRQGVEALRLPPDAVRDIDCADGGAPFRILATQAAVTPGAQARFTGTPRLGERPHGPLFTSLREALGPMGLTLTEGTPWPVELRAPRDT

SEQ ID NO: 16364 - protein, 113 aa, Myxococcus xanthus
MRDMVVACLRPYPGLTFSHASSGLEAIERLSLQPCDLLVLDLNMPDIGGIEVVEFVRGQDRLRELPIIIVTTRGDEASRTRALAAGASRFMTKPFTPDAILSEVRGLLEGRRA

SEQ ID NO: 16365 - protein, 664 aa, Myxococcus xanthus
MGHRQLLALEASIRRGLPHPRAVRELFRAVHTIKGLSAMVDVEPIVDIAHWMETCLRHADRAGGRLPEASVEPLMEGLREIEQRVRQLAVGKQAAPVPPGLLSRLEALDAEGAPGGSVARAAPAALALEEAVASRLSAVEREQLTTGATDGRRAVRLDFIPGADRAANGITINSVRERVASLGETVKVLPLSGPAVGGGALTFVLLLLTEASDAALLEAAGGPPASVRPLAAVAPRTPALAPLPESALADEEPEEARRGGGSLRVDVSRLDEALERLAALVVNRSRLTRAVAALTAAGAPTRELQAILQENARQLRDMRTAILRLRMVRVGDVLERLPLLVRGLRRSTGKSVRLELDVGDAELDKAVADRLLPALVHLVRNAVDHALESPEARRAAGKPEEGVVRVASHGRAGGLLDLTVADDGRGVDARAVAARAGMPVPPTPDALLEVLCRPGFSTRDAANATSGRGMGMDIVQRIIVDQLGGELGMETRPGAGTTFRLRVPLTITLLDALVFECAGLRYAVAVGSVEELVEVDAARLVWPAGAGGVALLERRGNSVPLMGLARLLGRGEADGHEGSVAKALLVRQRGELVAFGVERLVGQQEIVLRPLEDPLVRVPGVAGATDLGDGRPTLVLDLAALGLARGGGAPHRRRASVWEEGRLA

SEQ ID NO: 16366 - protein, 148 aa, Myxococcus xanthus
MSVLHVVFKVDGAEYVLPAADVLQMESFTGATPVPGAAPHVAGLVQVRGRVIPVVDARLRFGLPPVERTLDSRVVVAQLGSRVVGLVVDSAREVLKLDPQQLKPPPPLVVEGARGFVKAVAQVGPRLVMLIDFPRVIGEETLDGDGQR

SEQ ID NO: 16367 - protein, 225 aa, Myxococcus xanthus
ATDSGNAGVALEEARTLAEDAARSVQESVGLVQAVEGLATRLAAGGNEQAAASEQVRAAIESVAAHVEETGQSVHELVRSQRTVSDSARAQVQEAEANAGTLHEVNASVAGVRKDAAHLAASADTTAGALEEVSRSVKGVSANAEELAASSEELLASMTEMNATVADLVARNQSSAAATDQVSAAAEEMAKGIVRLSSYSQGVGERKRQDPQAGPSTGRAPLVKG

SEQ ID NO: 16368 - protein, 474 aa, Myxococcus xanthus
MGNDIDNIPPVTRPEPDAGTQSDAGTEPDAGSEPQADAGSGPVEGPWPTDAVTNYSSRYNISRAQAVGVDAAHNIWLLDGDRIGVLRADSRQVVWTRAPIGQAQGGFGPDRAATGSTVICGGSAGRAYVGYATTDLRADPDFPGLQPNYIVSPNECYQPDPAQPCFPYSHRRLQYYRQGDVDVVRLDGSRQIVLEEHLHQSVRNSTDANGNPRVQTGPRRLDDVHNLGIRNSNDHHFDEDRSILSCVTVMHGRDEGDVYVGSNHGVTRIRGLEYNSHRHPVWLNEKGSQMAGYTYGLGIAQDGDVLIANEWMFGIVTPTPHHGDWDNMDKRVNRMKVESSYLPQLNSISELDSWRGFQQTTDGRYYLGSKDHGLWEMTIMWASNQAQTGTRLTGANAEQNAALQNINALAATGDGSLYIGTDRTGLWRLTPLKTLEKVADVSGSRVRQLIYDPRVAPAALYVLTDKGLTVLRGN

SEQ ID NO: 16369 - protein, 176 aa, Myxococcus xanthus
MKKLIAAVALCVGSAAFAQQQPSQTQVPRPGTEKSTGVDATEVGPAIGKAAKDVTGIQTEDEGTFKMDKAMSLQGTLKEATADGVSLSRPGLPDADLDVRDKTVLMLDGKKVAKTDEIPEGASVRAKFQLEGDEVVALELRATSPKGAKKKQPGTGGAGTQPHESVDKELDGTPTR

SEQ ID NO: 16370 - protein, 77 aa, Myxococcus xanthus
MPDLILLDLMMPRMDGFAFHEALRHDTSFDRIPVLVASAGLDVKGAAEGLGVAGWLRKPLDLRELLNAVKRLSQLPN

SEQ ID NO: 16371 - protein, 106 aa, Myxococcus xanthus
MSHADLVDALGDEGYDRVTIYRNLTDLTEAGLVVRADLGDHVWRFELKRAGGGHSGSHPHFTCTDCGTVACLPEESVRIASSKGVPRAVSQRSVEVQLRGLCDGCN

SEQ ID NO: 16372 - protein, 136 aa, Myxococcus xanthus
LKKRRFTTYERVEELYPLIVKKDGRREAFDREKIVNGLKKACEKRPVSADQLEETVVAIERQLQGMGEKEVPSSVIGEEIMRRLRQLDEVAYVRFASVYRSFRDIAEFMDELKALREAEAREQRQAPPSAPVDKGG

SEQ ID NO: 16373 - protein, 277 aa, Myxococcus xanthus
MAIIEAGVRRVICASADPNPKVSGKGVSRMRRAGLKVLTGVLAEDADRLNRPFFKMIRTGLPWVTLKAAVTLDGKLATATGDSRWVTGAPARAWVHRLRDSVDVILVGANTVRKDDPKLTTRLPGGGGKDPLRVVVDSHLRLSPGYTIFTQRSAARTVVATLEDPEGRKARRFLAQGVDVWQLREKAGQVDLKALLRRLAKGGHNHVMVEGGAEMYGSFLRGRLADSLALFLAPKLIGSPGLSWAGDLGVKEMAQALAVKDLAFERHGDDILLQALL

SEQ ID NO: 16374 - protein, 220 aa, Myxococcus xanthus
MFTGLIQDLGRVERVIPGGMTDLWIHTSLGAAAFELGESIAVNGACLTVVERTGDSFRVQAAPETLRRTTLGSVKPGDQVNLERALALGDRLGGHLVSGHVDAVSEVLETYPEGGSWVMGFRLPEELAPYFIEKGSVAIDGISLTVNTVEADRFRVQLIPETQERTTLKARGVGSKVNLEADQIGKYVARLFALQRGQGAPGGRGGLTAAAIAAAGFGTP

SEQ ID NO: 16375 - protein, 167 aa, Myxococcus xanthus
MPRYFDGDFLPPKGRFAICVARFNGFITEELAKGAVDTLVRHGVADADIDVYRCPGTYELPGLVRRVTETRQYVGVITLGAVIRGGTPHFDYVAGECAKGIGAVAFEAAAATPAKTVTFGVLTTDTVEQAIDRAGVKAGNKGAEATLACIEMVNLYAKMSATDGRKA

SEQ ID NO: 16376 - protein, 140 aa, Myxococcus xanthus
MGARRTGRERALQALYQLEMATATTAEALESAWSAAEESNKRDPDAVKFARELVEGVQSHRDEIDQLIERHSHNWRLDRMSRIDRNVLRLGIFELKYRPDIPRKVSINEAVELGKNFGNEESSAFVNGLLDRVAVALNKP

SEQ ID NO: 16377 - protein, 65 aa, Myxococcus xanthus
MAEAGRVLSKARVESVALEVPAGGQVEDAARAAAFQKGFLPAFKGERVAVLADKGLVKSLPARKG

SEQ ID NO: 16378 - protein, 124 aa, Myxococcus xanthus
MRVKVLIVEDSKASREYIAAMVEAVEGVEVVVTSSGFEALKLLPRHRFELIITDINMPDINGLELINFVKKNPNYREVPLFIITTEGRDQDRERGLALGAAEYLVKPFLPGSLEALLRRYLKLP

SEQ ID NO: 16379 - protein, 733 aa, Myxococcus xanthus
MGAPAEVAADDPLDRLELEAQVRSVFTEYEEHRLRENVRRGVSLWRVRAAFDLSDFDKGLAELNARLKPLGEVISTLPSAQPGGAHGIAFDLIFGAQVDRVSLETGLEGTPAELSALTVRPAAAAATSALLQAAQPAATIRASGGAKSETRTGDAATHDGDASTAQDAVAGGLAAPDAPVRVTDTAPEASRKGATPSRGSRGAASRGTSADAKDAPAAGHSTSPKGGGKKKGVRATPAAMSPEAQQPLLSHVPEDTEPGPLEWPTSDADVPANASGSPSLTPVPGPSSVPVVAYLQGAAKASPKGLSVAPAAPAGAPVSTPAALTADTSLRSLTQTVRVDIGRLDGLINMVGELLLIKANLQRLAESARQDGAVALSKLFGQELARETRGLERKLEALQEGLLEARMVPVGQVFDKLARLVRRITREAGKEIELAISGGEVELDKLIVEELSDPLMHLIRNAIDHGVESPDARLAAGKPRRAVVGLRAEQKGNHVVIEVSDDGSGIDEVRVREVAITRGLITFAQAQEMSRRELLNLIFQPGFSTARSVSELSGRGVGLDVVKNNLGNLSGIIDVWSERGKGTAFHLTLPVTLAIIRALLVGVSGRTYAVPLNSVLEIISVQPKEIRTVERREVLDLRGQTLPFVRLSRMFALPERPVSRHFVVVVGLAQERLGIAVDELHGQQDIVTKPLGGRLQSVRGISGATELGNRRTVLVLDVAALLEEGMAVERRRA

SEQ ID NO: 16380 - protein, 105 aa, Myxococcus xanthus
  unsure (1)..(105): unsure at all Xaa locations
MNLRGELLPVYDVKVRLRLAERAPLVAGPDAPAPPRSARILVLRTETGPAGVWVDGVVGVVXLKPSMLEAPPPGLRVGDRDCVVGMGRRGPMLYILLDAEQALAP

SEQ ID NO: 16381 - protein, 174 aa, Myxococcus xanthus
MKDSVNLLSRRPHVVPDEVSSAADTVVQLCAFFIGAEEYVLDIMRVEEILPLQRITPIPHAPAFVEGVLHLRGLILPVVDLRCRLLGSPGPETPKTRLLVCKLGTRRVAVKVDRVAEVLRVRRGDIKPAPALRVAGHTPFVVGVCGPPDRLRLLLDLKALLRVELERESSRNTT

SEQ ID NO: 16382 - protein, 125 aa, Myxococcus xanthus
MGHQGLEQHRRILGILFIVINGLSVLIAVGVMLFFGAMGGMLPSAKPEERALIVAVGMGVGGCLALLGLPGVITGFGLLYRKAWSRTLTLVLGILAIPNVPLGTALGAYALWFYLQPGSDQVFDT

SEQ ID NO: 16383 - protein, 659 aa, Myxococcus xanthus
MNPHSEPPVEEEARYLALQSLDPCTAGVLEILIVGLHDESWRVRHVAAEALKRMPASSELAARLISVLGERGETGARNAAAEALAGLGSVALGPLVDLLAHPDPDQRKFAADILGQLGQRESEGPLVRSLSDADLNVRVSAAEALGRIGGAQAVTALETLLAEPEPLLRLSALEGLTLLQHAAPLPVVKALLEDPRLQRSAYRMLGLLPEADATVRICQGLTSELRSVREAALSALGTQAARSAGARRGELEAVVRKALLPLPGMTPRLTAALASEDVMVCAGTLVAVASLGDASLAVPVAECAREARLLREVLRTLGRLGPDGGYILLHRLPDLSLPARAAAAEALVDLVDASAVAPLCALLEWVEDELRAVVVRALGRTGAASAVSPLVALLEEPSLAGAAMRSLAGLAESCRPAVLEALEDAVARRATPAAVAALARVGGVPALPTLKRLARDEDPRWRAAAVVAACELDGDVGRELVRAALADESVPVRIAGTRALARLGGPDAGALLSPVLRDEDPSVRVAAVEAAGDCGALDRVPDLVALTRDADGALAVAAVRALARMGAAGPGVLREAAGHPDVEVVKAALVAGAESSAGVTMALSLLRHARWDVRAAAARVLGDSAGPECLSAAREALEAESDALALRALSDAVERLLRR

SEQ ID NO: 16384 - protein, 820 aa, Myxococcus xanthus
MTLAMSLGIGSKALAQPPRQLHAGEIAAGLKRLGVTGSVLYVAAHPDDENTRLLAWLVGERGLRAGYLSVTRGDGGQNLIGTEQDALLGLIRTHELLAARSVDGAEQFFTRARDFGYSKSAEEALRIWGHEEVLADVVLAIRRFQPDVIITRFTTEPPNHGHHTASAQLAAEAFIAAADPKRFPEQLSEVKPWKADRLLQNASQWWFKPDEDLSRYVKLEVGGYDALLGRSWGEVSAESRSQHKSQGFGQAVDRGPSTEYFTPLAGTLPKRDVFEGLDFSWSRWKGSEAVSRAVAAATKAFDARAPHRSLPALVRVHEALTALPDTHPWKAPKLRETEALIAACAGLFLEVRAAAPTGIPGLPVALDVVALNRSPAAVEWVGLTLPGEKPEAVGKALGANVPLKLSRTVTLPTTAPISTPYWLREPVTGGLYTLEGEDRALTGQPEGVPALSVAFEYKVAGRRFRAVRPVVYVWTDPVRGELYRDFEVVPPVTATLAQDVLMFPNSESRAVPVVLAAGMDQVLGIVRMVAPPGWRVEPSAVAFKFEARGDEHTITFQVTPPQGSTRKGDLSVNVDMGDRAWSWRARSVSYPHIPPLTVRQPSTATVVPFSLATKGKRIGYIPGPGDRVAESLSAVGYEVTLLPEERLAQEKLERFDAILVGVRAFNANTHLAVHRERLLQYVEGGGRLVVQYNTNSRVGPLTSFVGPYPLEIGRDRVTDETAVMTPLRADEPLLRAPNALTAADFEGWVQERGLYFASSWDARYQPVFAMHDAGEAPLQGALLVARHGKGTFIYTGLAFFRQLPAGVPGAYRLLANILSQ

SEQ ID NO: 16385 - protein, 290 aa, Myxococcus xanthus
MARFDDGRPEMSAEEFRLLRDHVYSHCGILVHEDMKFVMERRLWPRLELLGLPDYGAYHRYLRYDANRHAELEAAVESLTTHETYFFREPTQLKAFTDELLPVVGQRNARLRRLRVWSAGCSSGEEAYTLAMLLKDSRRFDDWDVEVLGTDISRRVLAMARRAEYGPSALRATSPELLERHFVSLGNSRVRVRDEVRAWVSFGHHNLLDEVGSQLVPRMDVVFCRNVLIYFDLAARRKFLRIVRDRLVPGGYLLLGHSENLLNLGSDFEFVHLRGDLVYRRPELDEGARR

SEQ ID NO: 16386 - protein, 345 aa, Myxococcus xanthus
MSSKGVISVLVIDDSAHNRRTLSTMLESEPDVRVVDRAADGEEGLKKVVDLKPDVVTLDLEMPKLGGYTFLRLLMRTAPTPVIVISSYSHRSDVFKALELGAFDFIAKPQHPTFEAMEALRVELLEKVRAARHVRPGYRHAAPGARAMAVAGEPPLVVSVGASTGGPPAVQRVLEGLAVEPTPCVLVCQHMPPQFTRAFADRLDRIGPFSVTEARDGDLVQPGHVYIAPGGRHMVVAERGSRLELQTPPPTPVDKYAPCVDRLFVSMAQVLGAKALGVVLTGMGADGAEGARAVHRAGGEVWAQSEETSVVFGMPGEAIATGAVKRVIPLGDIGPALAALARRRR

SEQ ID NO: 16387 - protein, 106 aa, Myxococcus xanthus
MYALQRLSGVVCTEAQDGAEGLKKLTQGRFDLVLTDINMPLMDGLKLISHIRQATEYRNVPIIVVTTEGAAADRERAMKLGASAYLVKPVQAKVVLDTVRDLLKLD

SEQ ID NO: 16388 - protein, 189 aa, Myxococcus xanthus
DSVLRVEGLEKAYGEVKAVQGLTFEVAPGEVLGLVGPNGAGKTSTLRCLAGILPPSSGRILVAGYDLSRTPVDAKRALAFLPDEPRFFEYLTVWEHLNFTARLYGVEDWEERGRALLEEMELTGKEKSLPGELSRGMKQKLSIACGFLHSPKLILLDEPLAGLDPIGIRRMKASLRRRAEEGTALVLSF

SEQ ID NO: 16389 - protein, 423 aa, Myxococcus xanthus
MSCLEDRDASVRALAADTLSRIGSPAAVPALFERLVDEDLRVVQAAVGAIQSLGSDTTEKLALQAARSPDARLRRAALRIISYFGYSKGLEVLLQAMRDPDERLRDAAIYGLPFIEDPRAVDALLTAANHESERTRAAAMRALGQTEKEARITSTLLRGLSDRDPWVRYYACQALGKLNEEAAADAIVALADDAAGQVRVAVVDALAHMHTESAMSALQRAAVSADADVRRAALLGLGVGRRPDALPVLLEAAKSEDAATRLVALSAVAEYEAPETLPALLHAAGDGDDSVRSAAVGFIATRPGVPATQALVSLLGDMTLRERVVSALALPLEGRLPGLLAALEAADEVTAPLLVAALARMRRADARAALMQLLVSASPAGRRAAVPAVAALGTLEAREALERASHRDEDPEVRRACRLVLSR

SEQ ID NO: 16390 - protein, 268 aa, Myxococcus xanthus
MSPQVFAILAALIEQRSGVHYAPEDRELLADKVVPRALDAGFDSLLDYYYFLRYDPAGSEALDALVDSLLVHETYFFREALPLRVLAEDLLVPAVRAGRRPRVWSAACSTGEEPLTLAMILAELGALDEVELLASDLSARALERARTGEHNLRSLRALPPGVEGRWLETCEGRPRVRPELVRAVDWRRVNLVDASAVAQLGTFDAILCRNVLIYFQDDTARRVVSSLTRALAPEGHLLVGTSESLMRFGTALACEERRGAFFYTKARP

SEQ ID NO: 16391 - protein, 348 aa, Myxococcus xanthus
MTVVSPIRVLVVDDSAFARKVLRQVLSSAEGLEVVGVARDGLDALEKVAELSPDVLTLDLVMPGLDGLGVLRALASSAAAPRVVVVSSAGEESELAVAALQAGAVELVNKPTALATERLYELGGELVAKVRTAAGAVARAPPEPAPSPEATSAPVARAAAKSLVVVGTSTGGPQALTRLLSELPVDFPAPLALALHIPTGYTEAVARRLNAHCALEVFEAVDGLELRPGRVVLARSGQHLKLERHGPVTLARLDRQPLRTAHHPSVDVLFESAARSWGSDVVGLVLTGMGDDGVAGARAIREAGGTVLTESESSCVVYGMPRAVKEAGLATDSAPLEGMLALLRRHVR

SEQ ID NO: 16392 - protein, 311 aa, Myxococcus xanthus
MLWCLAMPVVALSMYVAPGWIPYLCPLACYLALSAGVIAHNHNHCPTFRNRKLNEAMGMWLSLFYGYPTFVWIPTHNLNHHKFVNKAGDATITWRYSKKHNFLVAFLFPFVSTYWQQEPTKAFIDKARERNRPLYRQILTQYAVWGGTHAALLGLAMAMHGVAGGARIWAFAFLVPALFSLWTIMFFNYIQHVHTDPWSEHDHSRSFTGRLINFFLFNNGLHAVHHETPGLHWSLLPQAHAKIEAAMDPALKPVSFFAWCFRSYVVAPFLPRFGTAQVGRAPYEPPAGVALDVRFGDDLQAVDSGVNVARV

SEQ ID NO: 16393 - protein, 295 aa, Myxococcus xanthus
MGLRALRLRLGGDGPPVVLVAEPETPAEVLEVGDAEGVEDCLLSPLRTHELRARLAMLAGGGVPAASVRAYRVRSRLLLLAGASGPLAWSGLGALLEACGHRILYSATVGGGAARVAEQGERPDLVLSREGAPGVPRGLPSPRLQPLLAGVPSLTLDADAPVRPASLLPRIHALLGREDASLRVEARVRFCCPVSFGESGPRGAEWRSGVSSALSPGGLLVRTLVPAKAGTAVELHILLPTLGERLETHGVVAWAHAYAPRNGVSHPYGMGVRFLGMGPPRLMQLRQLCQAEVRP

SEQ ID NO: 16394 - protein, 102 aa, Myxococcus xanthus
MLLAELGHDAIVARDGLEALARAEQERPDLVFLDVLMPHLDGLETCRLLRDREPTRRTPIILCSARAEARSVRACFNSGCNDFVAKPFDGAALVALLRRYLD

SEQ ID NO: 16395 - protein, 286 aa, Myxococcus xanthus
MLTRTAYEGGCLVLHERFDADAANRAIDGEGVSHASLVATTLERVLEARGDRRMPDSFAWALIGGGPVPVPLLARARAAGLRALQTYGLTEACSQVTTERPDTADGRTAGVPLLGVEVRIVGAGGEVLGAGAEGDIEVRAPTVMAGYWQRPEATQEAVRDGWLRTKDVGVLDGGGRLTVLSRRTDLIVRGGENIYPAEVEAVLVNHPAVQEASVVGFPDDRWGERPVAFVAPRQGQPHPGDEELAAWCRQSLAGFKTPARFVWVDALPRNAMGKVERTVLRRHALR

SEQ ID NO: 16396 - protein, 137 aa, Myxococcus xanthus
MWFDISSQGCQAWDSNHGSNYHFAIGAPTLSFNANWDEVIAGTLRAGQQLIVNYDEARLPECRATYNGPAWSIVAQYRFDNGPIQETVVTGSGRSEPTAITAPAGARHLEMWFRNTDRSSCVSYDSNYGSNYHFAVE

SEQ ID NO: 16397 - protein, 265 aa, Myxococcus xanthus
MEVGVVCAAAVEATSTSGRREGRNRRTKMRSFRAAEGADGGSPLPRIRSMASPLIHIGWKAMLRGESELRRAADGGLIEQRARLLLDFTRTRLMGGVAIEPRPVDLKDLVAKVAHEFGVAFPQRTVEVDPKGNTQGVWDPDRLAQVTSNLVENALKYSPPETPVRLTARGLRTRVVLEVHNAGRPIPDNLLPHLFEPFRGGPQSSRTLKMSYGLGLFIVREIVQAHGGTIEVRSDEAEGTTFTVTLPRRSMPARPPQPPTGSPRD

SEQ ID NO: 16398 - protein, 145 aa, Myxococcus xanthus
FLWVLGDHASPRPPPSVEPGPEARRRRFLVVDDSPLTRELIANLLEAVGYDTVIASDGAEALEVLESHPVDLVVTDLEMPGVNGLELARRLKGHPVHSRLPVVILTTRGGEEDRRRGLAAGVDGYITKGDLVRQDLVDVVRRLLG

SEQ ID NO: 16399 - protein, 105 aa, Myxococcus xanthus
MGQKAAHDFLESVAGRTLLMLAYDEPRLLLGQLPTGFLAAVSYGERRMVWTGPRSGRFVMKRDFMPTAYHEGVLHAALEAVGARDIGVQGRELGLLDTEYALSWR

SEQ ID NO: 16400 - protein, 122 aa, Myxococcus xanthus
MSTPNLVLLVEDHADSRELLEEFLTLEGFTVETAGNGLSAWERLSRPPLPAAVLLDLMMPVMSGWELMRHVREDARLSTLPVVVVSGAGSSQPLPEGIRATVPKPVDLFELRATLERVVSPA

SEQ ID NO: 16401 - protein, 131 aa, Myxococcus xanthus
SGRARFAWALVVGLLGHALNRFPVEVIPGIDILLGFFLIIPAAPLLGPWCAGLAAGIATSATVQLWGHPWSMLGSMMEGVVLGALTRRYWPLQADGLFWLGGIPYLIIVSHRLGVDVTAASTLAIAVKQAI

SEQ ID NO: 16402 - protein, 98 aa, Myxococcus xanthus
GAWTELVWQPHEKWAVVPGLRVDNYHLSPGIDRRALEPRLTVRHKVSEALTLKGGAGLFHQPPTTLISLPVVDVGSLLLGLQQGVQLSVGAEGRRAES

SEQ ID NO: 16403 - protein, 307 aa, Myxococcus xanthus
MLLPGVGSMLSGVAYPVVRGSQPAATGYFLDGIRVPILFHLFLGPAVIHPDFIDAIDFYPGSPPPRYGRLMGGAIDGRLSRPRDDGVHGSAYADLINAGFFIETPFKDTGTNVSLAGRYSYTPWLIALAANQLQSPPPPGRENPKVVLDFWDYQGRVEQRLGEGTLRLFAFGSSDTFGSKAQDAWGDTAMQSIVFHRVDLRHRHPVGPGELEVGGTWGLDRFAIVSRSPPGEATEVHIDQGHWSARLGYSATLSPSATLRGRGGRGAQARHRRTAPAGRRLRRGRRGSARGAGDLHGRVDGAGVAAP

SEQ ID NO: 16404 - protein, 61 aa, Myxococcus xanthus
MRYVVRTKGNRRPLVGAMLVSDAHPDAPVQADVDGRFEALLARGRACGVYLRPRPQARRLQ

SEQ ID NO: 16405 - protein, 78 aa, Myxococcus xanthus
MMPSVPTLFRLCLALRLSADVGLGLATAASVGAALWEEDSRHRDQLPEMRKVLRTLRRMSRSQLNLMNQVAAAILPER

SEQ ID NO: 16406 - protein, 272 aa, Myxococcus xanthus
MPAAEHALELALLDLLAQRQGVPLCWLLAEEARTEVAVNALLGADTPEALAGEARQAVAEGFGTLKLKVAGRPLDADEARVKAVRDAVGPDVKLRLDANGGWSEPDAKRALDRLGWYGLELVEQPTPPEDLAALWRVQRRAPCTVAADESLASPDALRALLTVDPLLGGGPAVGAVVLKPMVLGGLLPCLVVAMRAARLGMQAYVTSSIDGVVARAGAAHLAAALPSGALASGLAIGRLLAKEPEDHPYHPQQGVIRLSSTPGLGLSSQSLV

SEQ ID NO: 16407 - protein, 352 aa, Myxococcus xanthus
MEVQRQEAKETGLDLSVVDLSASCAATALTLSAAIKNERPTGIGNSTAAVYAGTPGAGGVRLGTISVPWLVGGETFPFSLSYTVPEGTTKVVVVADEDGTYPEDDEDNNFASIDFEIPCATNQQPVANCQNVTVPADAACQGSASIDNGSFDPDGFPGPFSVEQSPAGPYGLGTTSAQLLVSDGAATRTCSANVTVVDVSAPTPGANRGLVIQPVLGSDYVLVSLDDCAMPAVDNCGGELDLGASASIIRVTSDESNDALSLLRLLACDDIKLSPDRKSAMVRAEAALLGNGRVYNFTYSVKDASGNSAIGTCNVKVPALLANPAIDSGVVYCQGDNCPSGSRSPGLLCSLL

SEQ ID NO: 16408 - protein, 799 aa, Myxococcus xanthus
MSAWEVEVRRIPAAQALPRLALRDGLPRLLEVVASLMRRGSPGGVGDGLGDIPDRHAIERLGEGFDLRQVVTEYRLLRACVLRLWTSRENATHRPEAELVFHEAMDEAVAASVSRYSLARERTLQALDRISTAALGSADAAELLPALLQVLRETVAVVDVAAVLLLEEDVLRVQSVVGSGMAVGDVVRMGEGFTGTIAATRQPLLVRAARTDSRVSEPSLRDADLSALFGVPLLLGAQLMGVVLMGSRATHELSEEDQFLFRAMAARTTALLLQAQAHAREREARAVAEASLERLRESEAGLRRWAQVFKRLGVGVAVVDATEERLREVNPAFARMHGYSPEELTGRRLEDTYAPEARGVLPRHVAAANSKPSHEYESLHMRKDGTRFPAFTHVTAFKDESGRVEQRVATVVDITQRRAMEMDRQRLLGAIEAERARLASVLDQMPAGVFIADAPSGRLVMASRQVEVITGRPFHPSTSMQDYMSDNGVSLHPDGRPYAMEELPLTRSLHHGEVVQGEEMLIPREDGQNIAVLLSSAPILDREGTIVAAVATMVDVSERRRAQEASLQAARFGERLIAIVSHDLRNPLNAIQLSATQLLHSEALPERERRLVTRIARSGDRMKRMISELLDFTRGRLGGGIPIQRTAGDFRAVVRLGVDELEAAWPERKLAFRVEPGRYEGEWDGDRLLQVVSNLGGNALQYSPADAPVSFKLYDDGDFVVLEVQNPGEPISPEMLPRLFDPFRRGAMAGVGGASSSGLGLGLYIVEQVVKGHGGRIEVTSTAQAGTTVRVTLPRLPMA

SEQ ID NO: 16409 - protein, 1083 aa, Myxococcus xanthus
MPKRTDIRKVLVIGSGPIVIGQAVEFDYSGTQAIKALRDEGVEVVLLNSNPATVMTDPEFAHRTYIEPITVEAAERILASERPDSLLPTMGGQTALNLAKALAEQGILEKYGVRLIGASLDAINKAEDRQLFKAAMQKIGVALPKSGYATTLDQAMSLVEDIGFPAIIRPSFTLGGTGGGIAYNREEFETICRSGLKASPTTTILVEESVLGWKEYELEVVRDTADNVIIVCSIENLDPMGVHTGDSITVAPAQTLTDREYQRMRQASLAIIREIGVETGGSNIQFGINPKDGRMVVIEMNPRVSRSSALASKATGYPIAKIAAKLALGYTLDELRNDITRDTPASFEPTLDYVVVKVPRFNFEKFPHADRTLTTSMRSVGEVMAIGRTFPEAYMKALRSMELGRVGLESPELPAEKEEREKVLREALRIPRPERPWFVAQAFREGMTVEDVHALSAIDPWFLRYIQMLVNEAQSLQEYGRLDQLPDEVLRQAKAHGFSDKYLGRLLGYPAEEVRAHRHARNIRPVYKRVDTCAAEFEAYTPYLYSTYEEEDEAPPTDRQKVLILGSGPIRIGQGIEFDYACVHAAFALREAGYETVMVNCNPETVSTDYDTSDRLYFEPLTIEDVLEVSQREKPVGAIVQFGGQTPLRISVPLEKAGLPILGTSPDAIDRAEDRERFAALIEKLGLKQPENGVARSHAEAFKVAERIGYPVMVRPSYVLGGRAMETVYDVASLERYMREAVSASPEHPVLIDRFLKEAIEVDLDLVADRTGAVMIGGVLEHIQEAGVHSGDAAATLPPHSLSPDLVERMKDQAIALARELGVVGLMNVQFAIQGKTIYILEVNPRASRTVPFISKATGVAMAKIAALCMVGKTLKELGVTQEPEFKHVAVKESVFPFARFAGVDVILGPEMKSTGEVMGLANDYASAFAKSQLAAGVKLPKSGKVFISVKDDDKPAVVDLARRLRSMGFSLVVTSGTHTYLATKGIEAQVVQKVTEGRPNIVDKIVDGEIVLVINTTFGKQEIADSFSIRRESLMHSVPYYTTVQPARMAVGALESLKCTELEVKPLQEYLGINAAPPGTRR

SEQ ID NO: 16410 - protein, 140 aa, Myxococcus xanthus
MADILTSLHTFLVVGPNHTGEDLYRFDSKPESRGERYVQQVIGSANYRTGGDLNDFAHLWLNYQIEHHIWPDLPMLKYREVQPQVKALCEKYGIPYVQESVWTRAKKMVDVVVGKTSMRKLAPKRPAQDAGVAAVPAPAA

SEQ ID NO: 16411 - protein, 72 aa, Myxococcus xanthus
MLEESVSPRLFAKGLSDAEGSMLLAHGVLPHERKLEVFVQALHDVVFPGLERCGVDTTPGRQWVEHCRRSGA

SEQ ID NO: 16412 - protein, 361 aa, Myxococcus xanthus
MTDLFAPLELRKSVIAPNRIWLAPLTNTQSHPDGTLSDAELRFLAMRADGGFGMVETCAAYVSQDGKTWPGELGVHDDAMLPGLKRMAARIHEGGALLSAQLFHGGLRANAEVSQREVWSASAYDADGLHCREATEADIEGVIAAFANAARRCAEAGFDAVELHGAHGYLFSQFLSTVFNRRQDRWGGSLENRWRLLQETVRAVRRAAPSLVLAVRLSPEDARQARGLDLDESLEVARMLTREGVDILHLSLWKAAHNTLKRPDQHATPLFRQAVGTGVRIVVAGEVRTREEAEAQLARGADAVAVGRAAIANHDWPRRVQRGDALQVPPLSPTTLNAEGLSDVFVNYMRNWRGFVTDQPA

SEQ ID NO: 16413 - protein, 117 aa, Myxococcus xanthus
MKGHIHAFEPRAGGTYRMTLSYDNADHTAPGKTSAHEDVVEGLFVELVPNERIVQRFEFESDDPAYAGTMTMTWTLTPVAGGTRVTVTCEDVPEGIRQEDHIEGLTSTLANLAAYTE

SEQ ID NO: 16414 - protein, 124 aa, Myxococcus xanthus
MFALFSRLRSREPLLGTIASRYADGAFDQLIHLPEQEQAVVDHFYGRLDELRWYFTYTEDMPGTAQLIFSKLHKRLEESYRVLVVTLGPPVPPDGSRVVDVEAVRHDAAEAPPRKTLTRTTRRA

SEQ ID NO: 16415 - protein, 150 aa, Myxococcus xanthus
MERPRLLAQAGQELQHLATGGGSKLVVTLELTQEVDGTLRDAKLISLSGNPAYDAYVLNAIPASLAKLAAPPAGARGVRADGIHTLWAVEGRVVYLRKLKELKGQDAWYIAATSAAGILAGRFEETTGEIEVIDFRNPRFVCRSHLLRVY

SEQ ID NO: 16416 - protein, 98 aa, Myxococcus xanthus
MSIEDKIQAILMSISSDTDEEILDVMEQMANVRDQRASLGTGEADRKAGAKLESSMQELELRLQRLVEKRKAMFDLMSNMSSKFHEMAKTAISNLRSA

SEQ ID NO: 16417 - protein, 284 aa, Myxococcus xanthus
MAARPKTLTAALVPVLVGTGLAFGSGVGRLLPALAALLGAVLIQIGTNFINDYYDFKKGADTHERLGPQRVTQSGLIAPGTVLAGAGVCFALATAVGMYLVAVGGWPIIAIGLTSLLCGYAYTGGPFPLGYNGLGDVFVFIFFGLVAVTGTYYVQAGTVDPAAWWAAVPVGASGTMLIVVNNLRDVTTDVKAGKRTLAVRFGTGVGKAEYLLLLVLSYATPFAMYALKLASPWVFLSLLSLPLAVPPLRQVLKQEGAALNPALGSTARLQLVFGVLFALGLYLR

SEQ ID NO: 16418 - protein, 370 aa, Myxococcus xanthus
WTNVHGIDQTPDTVETVSGFPHKVYRDGAGNALVETWELTGMGHAVAMDAQFPFPGGTGSAACGSVGAYLSDVNLCSVYHQVKFFGMTGGGGEPTGDTTPPTVNVTAPASGATVSGTVNVTADAADAVGVTRVEFLVNGEVVSTDTQAPYAFAWNSTAVSNGQYTLGARAFDAAGNQATDNDTVVTVSNSGSPAPVTVQFASIAADDGYLKADADGSGAALGFMTNLALGRGTDGKYNRSFLSFDTSSLPDGATVTRAFLTVSYSSGSGDPWSTPAGNTLVIDAKTGTFNAANTEVTDWAAAATASSVAGIDRFSAGTKSSGDFSADGLSAISKTGKTQLRLRFTQAQTATQYLFIRDGANAVLTVAYTP

SEQ ID NO: 16419 - protein, 90 aa, Myxococcus xanthus
MPGGGVSLVYPAARVAEVLGLLTQAKLHPTVLRFVHARVGAPATRFLVHALRDRDRGLAVRPPLIVHGEGPGGYSAEVAALMDPPLAESR

SEQ ID NO: 16420 - protein, 168 aa, Myxococcus xanthus
MNVATLTEQPSILKAAALLPPRLSLGSTMVVHGVSKLRAEGTAQHADLFEQLGFKPGKPWVIATGVVELLSGVSSILGIATRPAALAILVTQAIAVAKVHGSKGFDITKGGFEFNLALGAIALGLLLRGPGPLSVHSAIERRVKRKELRRLRFLPRQRRRSVLLDVLG

SEQ ID NO: 16421 - protein, 423 aa, Myxococcus xanthus
MEALQAKDAPTAITQLSACVEAAPSRVDCRWELGWAHSLENQWAEAYTQWSEVQKLQPDHPDLEGALAQARGQAMLQAKLSQGPQLINRPPPPANAKVRIRAVGDVMLGTTVPEGHLPPDGAGSVIAGVRPLLEDADLTFINLEGPLCDTGETKKCRSSKNCYAFRSPTEYGQYLKESGVDLASTANNHSGDFGEECRRATESTLDALGIAWSGAPGTVATVERNGLLIGMVAFHTSPSCNHLNNLTTATGLVRVAAAEHDIVIVSFHGGAEGSKALHVPKGREKFHGEDRGDLRAFSRAVVDAGAHLVIGHGPHVVRGMEFYKGRLIAYSLGNFATYGRFNLRGPQGLGMVLEVELNRDGDFTAGRILPTKQVDRGIAVPDPKGAVIKAVRDLTADDFPETGARISDDGTVKVRGKGPVSMR

SEQ ID NO: 16422 - protein, 263 aa, Myxococcus xanthus
MSLNSAQFNLGRIIGPALAALVLSMGGTSWALLINTLSFVAVLVALSQVKTLTRKVTEGGQGLWKQIAHGFTVARGDPEISLMLWGTFLVAGLVAPFIGLVPVFAIRVFGQGAAATSLLVTCQGAGAVTAALLVGTLVDRWGQRKLLGIVATSIGVVSTLYWLSPTLQMAAVVIFVLGANYMMLMSGMHAYCQSRVPRELQARMSSLYSMVLGGAYASGVWGLGALADRLGIRFVTVSASVLFIALVLTLRLLRPQRFDGAVA

SEQ ID NO: 16423 - protein, 102 aa, Myxococcus xanthus
MPNRKYDPYTGGKEAATKPPYAPDRVERGLEADDTLPLYSADSIRDTREEKFALDSDSEVGGYVPDIRSPIDEADELERERRGRERAEERQVSDEEDEARNR

SEQ ID NO: 16424 - protein, 75 aa, Myxococcus xanthus
MLPKMFAPVGTSIIDRTFEPRPPTSETLDVWADAAQHALAYWSRLEQTPELSDTFRGHCARCRDSLAALMQRTPV

SEQ ID NO: 16425 - protein, 72 aa, Myxococcus xanthus
MMDGQRRGTSNATNLSLRDVPPGEHALEVDFTVGGKLRRSTLAVPASHELFVTASEEHGVQVTNTKPLTGTP

SEQ ID NO: 16426 - protein, 59 aa, Myxococcus xanthus
  unsure (1)..(59): unsure at all Xaa locations
RDASAAXVQRMAEQYLDPASMQIVLVGDPATIQEQVTPLGLGKLVPIEPDEAPVPRAAK

SEQ ID NO: 16427 - protein, 208 aa, Myxococcus xanthus
MSMERIRTDFPEVTLAILAGGQGRRLSGVPKGLLEVEGRTVLERLLALAPCFEDVLLVANVPGPYARFGLRTVADVVPGKGAPGGVHAALVAARTPWVVAVACDMPFITTEVLRVLLGARDDGVDAVCFEARGRLEPLLAAYRSALAPAWETTLATDPSMRELLSGVRTRLLSEAVLHAVDPSLRSLANVNTPEDLARYGVALPSWRG

SEQ ID NO: 16428 - protein, 285 aa, Myxococcus xanthus
MGVKLAYETWGEGSRPLVLLHGFTGSRRAFDGLRPLLGRDVRAVAVDLPGHGATPLPDQRGREAFVETVDALVALVDSLGQGPVDLLGYSQGARVALAAAVRAPDRFGRLIMESGSPGLHRRQERAARREADGQLAAFIRSRGVDAFVDRWEQLPLFDGLRQLPQERRDALRSQRRACTAEGLAGALECLGLGVQPDFWPELHAQRLPTLLLTGASDSKFTQIARRMATELPVVWRHAFEDCGHAPHLEAPEAYVREVLGFLQTPWYEAPQFDSPMPVREGRVAS

SEQ ID NO: 16429 - protein, 28 aa, Myxococcus xanthus
MIVGTERFMEAVRRLDLDGITFQALPAH

SEQ ID NO: 16430 - protein, 70 aa, Myxococcus xanthus
MPQAVKFTGWVHGLLFVLYLFALMEAAITYRWSFVRVVGGVFASLLPFGTFVFEARLRREAAEPAVEPVP

SEQ ID NO: 16431 - protein, 204 aa, Myxococcus xanthus
MERGKWDTPEDVERELSSRLALVEASEGIRGMHFAAVLDTVRFLGGEQAVAPIQQGGDYPADLDTTEFYPVPPFMRVFFSAARLLAPQLGGVEEAMRQLGVQGTLAFINSMFGAEVRQQVGGEPKRLVEMLPEAYRMAINFGELQVAWTGPRSGRIHMRRIFTPVAYNEGMLEGALLAVGAQDIQVRGGQTSLLDSEYTLSWDS

SEQ ID NO: 16432 - protein, 185 aa, Myxococcus xanthus
MKANNWKNLAAVAGVMVSVSAGAQESSGSFGSEGQFVISTDASASLGYSTQGSGIGYIFLEPGADYFLKKNLSVGSGLQVRALFGSGDTIAAFGLNARVGYNIPLSDRVSVWPKGQVSLYIGDDILPFANSALPANVTVILEGYAPFLFHVTPHFFVGGGPRLAFGLGDDVEVNFSVASTIGGYF

SEQ ID NO: 16433 - protein, 40 aa, Myxococcus xanthus
AGVEGRESCREQTEDHLTMRELMAELEELPSGHPEWQARL

SEQ ID NO: 16434 - protein, 297 aa, Myxococcus xanthus
MSRVPALSVVGWSGAGKTTLLTRLVPELAARGLRVAVVKHSSDAHPLHRPGSDTARYQDAGAVLTGFTTPAGVQLTTATALSDALPSLLERSAGAVELVLVEGWKDGPLPKLEVWREGLGPPLAPSRPEVLAVLSSEPALPTDFPPGLRVLHPDDVRAVADLILAHLRPSRPAPLPPVDARGVTRRFVQRWNGATLLPAQEDDIAVEEPLEIRVSGDSVATTMRTPGHDRELATGFLFAEGILQSVDDLGGLAHCGRPGEEGFGNVIEVTPAPGAFLDVERVSTARRGTLTTTAYGR

SEQ ID NO: 16435 - protein, 364 aa, Myxococcus xanthus
MDGWAVHAEETQGASRDRPARLRVTSTIFAGALPSTPLRPGEAARVFTGAPLPPGADAVVRQEATRAAEDGTRVDVFITVPPGNDIRRTGEEVLTGTPLFDAGQRVGAAVLGVLASMGATDVWVRPAPRVAVLATGDELVPPGTPALPHQVYESNLVLVAALAREAGADVRQLARARDDESALRDALSRLAPQVDILITTGGASVGDKDLVKRVLAALGARFFVDGVALKPGKPVAVARLGDTSVVVLPGNPGAATVAFDQFARPLLLKHQGVLETRRRVRAHLSEARRKQAGLTYLITTTLEARDGLAPRAVLRPQGAGQILQNVHGEGWALLPPGRADFAEDDLVDVELFDRPTFTPVGALA

SEQ ID NO: 16436 - protein, 597 aa, Myxococcus xanthus
MALPIEAHALIGDTHSAALVANDGTIDWLCWPRFDSDACFAALLGEPRHGFWRIAPTVPVRRVHRRYVRDTLVLETEFHTDAGTVRLCDFMPLREDTPHLIRIVEARTGQVPLHLEFAPCFGYGDRTPWARLIPGGVSTKAGPDALYLSTELPLRLEHSHVLADFAVPEGQRLAFVLSWHPSHLPPPRQPPDPFLTRADTERGWRAWALRCIHESPWRAQVLRSLITLKALTYSPTGGVVAAPTTSLPERMGGVRNWDYRYCWLRDATLTLLTLLDAGYTQEAQAWRDWLLRAVAGEPDELQILYGVAGERRVTELELPWLPGFAGSRPVRIGNAAVGQLQLDVFGEIADCLYHALRHGVCSDAEAWDVSVHLLRFVERNWDQPDEGIWEVRGGRQQFTHSKVMAWVAMDRMVKTANLRGMRGAQVEHWKALRAQMHADICARGYDARRNTFTQAFGSQSLDASLLLIPMVGFLPPDDVRVRGTVEAVRRELCQDGLVRRYHTHETRDGLPPGEGVFLACSFWLADALALMGREGEARELFERLLGLCNDVGLLSEEYDPVAHKMVGNFPQAFSHLALVGTALNLSREGGPVQQRSH

SEQ ID NO: 16437 - protein, 312 aa, Myxococcus xanthus
MSTDATHLPRSALLFLARRPGLEDAAMRLRPFRRLASRFIAGETLEEAVDAVKALSARGLMASFDHLNEAVQTPEETREEVRQYQRLLARIDAVGVRANVSLKLTQCGLLFDEALALENARTVVAEAAARDSFVRIDMEDSSMTQVTLDIVRRLRAEFGEPHVGAVLQSALRRTEQDAKELCAQRIRIRLCKGAYLEKPDVAFPDKQDVDASFVRTMRVLLDSGVYHGIATHDERMIEATLDHAAKRGLPRGAFEFQMLYGIRRDLQERLVREGHPVRIYVPYGRHWYPYFMRRLAERPANLAFLLRNLVRG

SEQ ID NO: 16438 - protein, 20 aa, Myxococcus xanthus
MRHPDAFNTLAGDFLRQPPD

SEQ ID NO: 16439 - protein, 348 aa, Myxococcus xanthus
MDGFAAAISALSQATGYPVLAESTSQARYGGGPLTLSYYDAMLRHAPFAKAHRPELVLRFGGGLTPKVPQQWLDGSGADTVLFSDGGGLFDPAHRASTVVEGSAVAACEALTRGLARGVGAWARGFLAAEQRVRTALEAAFAEQPDVLSEPRIAREVVAALPAGAPLFVSSSMPIRDLDAFAPAGTVPLRVLANRGANGIDGIVSSALGMAAAAGRSAVLLTGDLALLHDVGAFVTASRTRVPLTVVAVNNDGGGIFSFLPIAQVAPRDTFETLFGTPHGVDLSHAAALGGARLHRPETPVALRSAVREGLEGGLHLVEVRVDRNANVDEHRRLFARMAASLGEGPWA

SEQ ID NO: 16440 - protein, 667 aa, Myxococcus xanthus
LPCRRGIVFHNISPARFYEGLPLADALVAGRAQLAAMAPFADVAIGVSDFNAAELRVAGYRNVHTVPLFIEPERFSRASADAKMLQRLEGPGPVLLGVSRVMPHKRFEDLLALHREVLRLRPQARLLMVGGYEPGSRYFRMLQREARGLRGVSFLGRLSHAQLVAAYRSASVFVSMSEHEGFGVPLIEAMAAEVPVLAYAAAAVPETLGGAGVAFDQKRFAFLAELAVDLSEDVSLRGPVIAGQARRLEHFSAPSVQTAFTKALETVLPRPTPTKSRKVPERPRVAMVVQRYGEVTGGAEKLAAQMAEHLAPHWDLTLLTTCAKNHLVWDNAFPPGPDVVDGIKVLRFPSTRVRNIRGFNGLSRQVFDKSNERLREEQWVAEQGPMCPGLLHHLATERDAYDGYLFFTYLYAPTVWGLPLVADRSLLVPTTHDEAPVRFGVYRDVFERPRALLCLTPEEHTLIEKYFPNHAPTRVVGVGVDRPRADGARFKEKHGIHRHYLLYIGRQEPGKGVPELLEYHQALKNRFEDAPDLVLAGDTNMELSGEGVRYLGRIDEQDKHDALAGALAVVVPSRYESLSLLTLESFAQGTPVLVNGRSDVLVGQVERSGAGRAYTDLESFIQGLREVGSEREPMGKRGLAYVKKQGWPQVVAAYREEMQRILEEKRR

SEQ ID NO: 16441 - protein, 131 aa, Myxococcus xanthus
MAGRRVVRNLHRHLQGRIFATLTDANFKLHFYDTQCGVKFVRADILRPLLDVLQEQRWLLDVELLVLLKRQGARFLEVPIDWEDFGGSKVIPGLDAARMFWGLLQLRRRLEHVSLPTHRDALPEGEPHAQR

SEQ ID NO: 16442 - protein, 1259 aa, Myxococcus xanthus
MRALTDLPSDPTSPLTLGLPGFVFEDLYRPAGLRRLAERFDAQLTEDEPELFQAFDAYRKSGGTSVSGAAESDLLVRVSRHVSRFVTRLFRVEQELERLSGRLKGELPLFDFKREFITRRVFKKGAADRPALAEFPSLDARMRLMLQLGFPEALATGDLERGLAESVLSLMDLERLFSNALPAERQGEAEALRARWSALREVLLSTPEGKDAFGSSLVTQGDDAAEIQSVRALLSLADRWTYARALHPETKDLFHAWPTHRIPKPLVFDQLVQLQRPDNELPEATEGLEHHLRHRDGFKLTDRRGTSRDVMNEVDYCVLCHERQKDSCTKGFPAKDPVAEGHHYKKNPLGIPLNGCPLDERISEAHLLKREGNSVAALAMVTLDNPMCPGTGHRICNDCMKACIFQKQEPVNIPLAETATLTDVLNLPWGFEIYGLLTRWNPLNVRRPYALPYVGRNVLVVGLGPAGYTLSHYLLNEGFGVTGVDGLKIEPFPDALVGRNGHSLQPIRDWSALTSELDERILEGFGGVSEYGITVRWDKNFLTLIHLTLARRESFRIHGGVRFGGTLTVEDAWALGFDHIAIAAGAGRPTIIGMKNNLIRGIRKASDFLMALQLTGAFKKDSLANLQVQLPAIVIGGGLTGIDTATELMAYYPVQVEKALARHEKLVSQVGEEAVLARLDAEERATYQTFLEHGRAVREERQKAKALGRDPDFIKLVRAWGGVSLVYRRSLTESPAYRLNHEEVTKALEEGIRFIERMSPVEALPDASGAVRALRFERMVTVDGKLKGSGQFFELPARTVCVAAGTSPNVTYEKEYPGTFQLDARGEYFQSHELVDAEDGFSLAPVKAKEDPAAKTGFFTSYQKDGRFISFYGDNHPTYAGNVVKAMASAKDGHPQVARLYAKEVAALDFTDEVAQAARDARRAAHFARLDEAFTATVVAVNRLTPTIVEVVVRAPFAASHFSPGQFYRLQNFERNAPVVDGVRLTMEGLALTGAWVDKEKGLMGTIVLEMGSSSRLCAALKPGEPVVLMGPTGAPTEIGHNETVVLVGGGLGNAVLFSIARSLKAAGCRVVYFAGYRQKSDSFKHDEIEAGTDQIVWSVDTGDTIEARRPQDAAFRGNVVQAMVAYAEGKLGPAPVISLADVDRIIAIGSDGMMRAVAEARHGVLQPHLKPGHEAIGSINSPMQCMMKEICAQCLQRHVDPVTGKETWVFSCYNQDQRLDQVDFVNLRQRLRGNTVMEKVADVYLAQLFKQAPHLKRV

SEQ ID NO: 16443 - protein, 80 aa, Myxococcus xanthus
MPVGAVEPVLNEYADENLVLVGHQPSMGALAAHLLGMQSFPKPVNPGTVIGLERAEGESSPAFKFLFYAAPGQQVLDIIQ

SEQ ID NO: 16444 - protein, 109 aa, Myxococcus xanthus
MDEARYNQLVSAAFKRILAAADTIDPDILEADSTGDMVTLTAASREKCIVNTQRAVRQIWVAGQGQGIHFDYDAATGTWKDDKGRGLELMSFVADVVRGITGADFVYPG

SEQ ID NO: 16445 - protein, 223 aa, Myxococcus xanthus
MRVRKVLWGLWVLVAFSACKKPEDASGPPAGVVGEQAPGAPDGVVEAGPYTVTKEKLDAYVGYQRRMLEVYGSLMKGLQNLGALVDAGTPEAMAAAREGLKVVEAKAKAEAEARREAQLSEADVNGIAEVVTAVVSQRQLGRTLQYEEELKKLEALQAKLPPEQQQGMAPQVASMRAQVEAFQTLADARRDYGDANIDVVLTREEDLIQNYQEMIRVFTGTRR

SEQ ID NO: 16446 - protein, 160 aa, Myxococcus xanthus
KRLMLMEVKRSRRYRYPIAVLLVDIDKFAEKAAPLAPAARKLALAEALGLLVSGVRDIDVAVPFADSRFVVFLPHTPRSGALVVGQRLRELIKSLTAYEGASASVGVAVSEPPSGRGPVAGALSQVSFGSLLKEAGEALRRAQAAGGDWVEAASGRTQPG

SEQ ID NO: 16447 - protein, 182 aa, Myxococcus xanthus
SFITIADLIEYRRRKDRLVRREPGQQTVNTRYGEFTALTYSWLPDGVKSLVLVKGDPASRPSTLVRLHAACALSDVFGSPSCNCNVLLDQALARIARESSGVLVYLPGMHGDDLGIHHKRNNDGSSGPTRGPQESRDLGMGCQILTDLGIHTLQVMTNSDVTYRGLAGFGLTIEKRVPLQPD

SEQ ID NO: 16448 - protein, 182 aa, Myxococcus xanthus
MSLALLRWGVFILLCLFAPQAVAGDAKPRRSEAKGSRLVRLKNGQLLHTDAADAYRRMKAEARSKNIYLWVHSGYRSPAKQRRLYERYRKGKGPQAARPGRSNHQRGLAVDLVIGGVKTPTYDWLVSNACRFGFKRTVRSEPWHWEYRPHSTREPKPGRDCVGRPLKRQRPQSPPVASTEKS

SEQ ID NO: 16449 - protein, 446 aa, Myxococcus xanthus
MSEESASDFRAEYACSEGCDFRASLMDVVYRCPRCGGLLEVAHDVKALRTVSAAEWKRRFETRFGSARLPDGSGVWGKREWAYPQLPAEDIVSLGEGRVPLKPLPRMAAELGLAALDLKECGVSPTGSFKDWGMTVLVSAVKHMRARGVPLRAVACASTGDTSAALSAYCAAAGIPAVVFLPRDKVSLAQLVQPIANGARVLSLDTDFDGCMKLVQAVTADTGLYLANSMNSLRIEGQKMVAVELCQDLGWEPPDWVVIPGGNLGNASALGKGFELMLSLGLITRRPRIAVAQAQKANPLVRSFRGGFQELVPLQAEPTLASAIQIGNPVSFKRAVKVLKAFDGVVEDASESELANAAARADREGTFTCPHTGVALAALEKLVAQGVIARGSRVAVVSTAHGLKFADFKVGYHRGSLAEVTSQFANPPVELPATLDAVKGALADLG

SEQ ID NO: 16450 - protein, 101 aa, Myxococcus xanthus
MGAVPVTPMPELDTGRAPDDGVRTAAPLGAVVCRYCRITQAEGLLCDNCGMRLPRAKPTVAAAPGRPSGDDDGWRSCASCHTRVRPGKACPECGTRAQEEA

SEQ ID NO: 16451 - protein, 212 aa, Myxococcus xanthus
MGDWGRADYLSRHGIKDARVLEAIARLNRADFVPEDLREEASADSPLPIGHGQTISQPYVVALMTEALQLQGDERVLEIGTGSGYQTALLSLLCREVYSVEIVPELAQSAREVLGRQGFENVSFREGDGSLGWPDQAPFDAILAAAAPPDVPLQLLSQLKPGGRMIIPVGPRGGTQQLLRIQRALRPGEVPQVESLLSVRFVPMTGQPLSQG

SEQ ID NO: 16452 - protein, 163 aa, Myxococcus xanthus
MTPSGLRKLKEELKHLQSVERGKISREIEVARAHGDLRENAEYHAAKEKQSHIEGRILTLNDWIARAEVIDPKKLGGDKVIFGATVDLLDTETDKPVSYRLVGEIEADLKKRWIAVTSPVARALIGKKVGDIATVQSPGGVRELEVQEIRFEEPEEEAPASGS

SEQ ID NO: 16453 - protein, 161 aa, Myxococcus xanthus
MWGTDATCTVTTLEGQATVFIAVDDGTAECVGIHAAKVGSRFEALEPIRRGIKARFGAYGQGVASGLAIRHDNGSQYTSDVFQNELRFLGANSSPSFIRSPEGNGCAERFIRPPRSNCSGCAPSPPWRNSGWTCWNGPTGITSTRYLSATTSFRRVRPSGS

SEQ ID NO: 16454 - protein, 92 aa, Myxococcus xanthus
RPDRLAVYSFAFMPEVLKHQRRMPAEAIPSGRAKLELFRSAYAAFVSAGYRPIGMDHFAVPEDELARAQAERRLGRNFQGYTVKAASYLGST

SEQ ID NO: 16455 - protein, 479 aa, Myxococcus xanthus
MSAAPQRDGPRIDQLTSIHADGSRLALHPADVHGRFITRRRVGFAVLIAIYLALPLVEVGGHPAVHLDVAARRFYLFGGTYNAQDFWRVLFLLTSVGFGLLFFTAWLGRVWCGWACPQTVFLEALYRPIERFFDGPRERRLKAAKEPWTPVRVARAVLKHGAYAAVSLLISHAALSLFVSAGGLIAMVADGPVASPVAFTWAMAVTGALYFNFAWFREQLCVVVCPYGRLQSAMQDRDSLIVGYDTRRGEPRGRLIKAAPGVPAPPPRGDCVDCFKCVAVCPTGIDIRNGLQMDCLACAQCVDACDGVMDKLGRPRGLIRYDSLNGLDGQPRRVLRPRLFIYGALMLVAVVGFTLSLVRRVPFEANLLRFQGMPYVVEQGTVRNQFELHLVNKNPSETVLTIRVDSPVPAKVVVPQAQVTLASLESFRVPLFITVDQSGTELPFHFTVEVADAASGEVKRMEARFLGPVYSLQPEAQLP

SEQ ID NO: 16456 - protein, 183 aa, Myxococcus xanthus
MSSDKPLVHSVYDGIEEHDNHLPNWWLFILWTSIIFSAGYWFWYHIAEVGPGQLGEYAAESAEVAKRASGNAPASDGMLLALAKDPASLESGKQVFQANCAACHGVQGQGSIGPNLTDAYWMHGGGPMAIHKVVADGVVAKGMPAWERTLGAERVKAVTAYLLTLKGTNAPGGKEPQGEPEQP

SEQ ID NO: 16457 - protein, 52 aa, Myxococcus xanthus
MSLTELPLFALVLFIAVFLGVVAWVFVARRSGDFDALARMPLSEQGEGRHEQ

SEQ ID NO: 16458 - protein, 664 aa, Myxococcus xanthus
DVAIAVIWVVFAINFFWTLAKRHEKNLYVAIWFYIATIVTVAVLHIVNSLALPLSGMKSYSVFAGVQDALVQWWYGHNAVAFFLTTPILGIMYYFLPKAAERPVYSYRLSIIHFWALVFIYIWAGPHHLLYTALPDWAQSLGMIFSVMLWAPSWGGMLNGLLTLKGAWYKLREDPVLKFLIAGVTFYGMATFEGPLLSIKSVSALAHYTDWIVGHVHSGALGWNGFMAAGMFYWLVPRLYGTKLHSPKAADAHFWLGTVGILLYMVSMWISGVTQGLMWQAANPDGTLLYPNFVETLLAIRPMYIVRFVGGSMYLVGFIMMAWNLWKTARAGKAVDGETTVVVEPPTPVAEPVPAKAPTPGWVQVVTGRPLVFAIAILTVTMFLGWAKPVRAVVLMGAIIALGEFAWIVTRRDREAGRPSWFGLIEGKPLAFTVLTLIAILIGGVAELLPTIMLKQAVPAHGQAQEPYSPLELQGRDLYVREGCYTCHSQMIRPFVAETQRYGDVSRAEEFIYDYPFQWGSKRTGPDLHRLGGKYPNLWHYTHMMDPRATSPGSNMPPYPWLAEQRIVVKDAPKKLALMQRLGVPYSNADVDSAEARQKTQAEGITADLAAQGVQVAWDSEMVAIISYLQRLGRGPQDLPAPPEKAPAPPDRLPAATIASEEGR

SEQ ID NO: 16459 - protein, 156 aa, Myxococcus xanthus
MSGITLVRNVVAGLAMFVGFTSMAAPAPVRAEPLYFAVEVRRDGRLVAQPKLLGETGRTLRAERRRPGAPLPDYRLVLTPKAEGQSFLLQLDLLLPEAKGHSELALLHGQERKLQLGRVPGELEVSLLLMKVDSPEFRALMQLGESGGKSLSTSSI

SEQ ID NO: 16460 - protein, 558 aa, Myxococcus xanthus
MPPPGEHGLKEIYGNTLGLKSSEQHRLRNTFRRRVPPHEIVSPELARHLTELSRELNRQVGVLVNRKGEIEHVIVGNAHKLELPDIGRARAGQVRLRGLRLVHTHLKGEPLTKDDLTDLALLRLDCVAAVGVGHEGLPGVLHYAYLIPENGSGDFWHVETLPSVHVAQSDLMDTLGALEEEFNRKAASRKVGGREKAILVAVCLDGNRALAESSLAELKELARTAGVEVIDSVLQVKREADPRYLIGRGKLEELNLRSMQTMVDLLIFDKDLTPSQGRHIGEATSLKILDRSQLILDIFAQRAQSAEGKLQVELAQLKYRLPRLVQSDDSLSRLMGGIGGRGPGETKLEIDRRRVRERITHLEKRIDAIGRERSVRRAQRNRRELPVISIVGYTNAGKSTLLNAITNAEVLAENKLFATLDPTSRRLRFPQEREVIITDTVGFIRDLPKDLVAAFRATLEELYDASLLLHVVDAADPARDEQVEAVENILESLDLMEKPRLMVWNKADLLPPDEVAALLRTRGGVAISAATREGLATLLAKADTTLFAEGATEAIGAI

SEQ ID NO: 16461 - protein, 33 aa, Myxococcus xanthus
MQQEGLVVSHTNSQRLTVWRVRGATPDAAPRRY

SEQ ID NO: 16462 - protein, 385 aa, Myxococcus xanthus
TDSFGTKSQLKVGSATYDLFSLGKLAKTHPAVNRLPFSLKVLLENLLRHEDGRVVKREHVEKMLAWDPKATPDVEISFHPARVLLQDFTGVPAVVDLAAMREALASMGGNPDRINPRNPADLVIDHSVQIDSFATSAAFKDNAELEFERNRERYAFLRWGQSAFKGFGVVAPDIGICHQVNLEFLAHVTFRQGSTVYPDTLVGTDSHTTMINGLGVVGWGVGGIEAEAALLGQPITMLIPQVVGFKLSGKLPAGATATDLVLTVTQMLRKKGVVGKFVEFYGSGLKNLSLPDRATIANMAPEYGATIGFFPVDEESLNYLRFTGRPDDLVALTEAYAKEQGLWRRDDAEDPIFSDTLELDLSTVVPSLAGPKRPQDRVPLKDMKS

SEQ ID NO: 16463 - protein, 420 aa, Myxococcus xanthus
MRDQEALTEQSGEVDTGAPRRAPTPPAPVPEHGPVWSPGVSGGLLTRYYLPRRHGVVQGNACQLLRDGVEAYPAMLEAIRGARRYVRMETYMFVSDAVGELFGQALAEAAERGVHVKVLYDAVGSWTSRRSFFAGLRARGVDIRAFKPFSLSRGLRHLLRRDHRKILVVDGEVAFTGGVNISAHWAPAEMGAAWRDDVLRIEGPAVHELERCFSATWRMMFQGRFHRLTRRLERLRNPPPRRGAVGLVVLSSRRSIHRAYLHAIRRARRSVLVAAAYFIPDRRMVMALREAARRGVEVHLLLNARSDHPILEFMARAFYERLLGAGVRIFEWQRGVLHAKTAVVDGVWGTIGSFNLERLSLAFNHEVNAVFADPRLGQQLEDSFRGDCGDCREVTLAEFRRRPLWQKLLERALSLLRKII

SEQ ID NO: 16464 - protein, 317 aa, Myxococcus xanthus
MKAAAIDRFGGPEVLGVKTVAVPVVGAGEVLIQVETAGVGSWDAAEREGEMELLKPRKSSFPYVLGTDGAGTIMAVGEGVTSRKVGDRVYGSGFLNDKGGFFAEYAVVKADDTALVPKGLSAEQAGVLAADGITALQGVQDALNVRQGMSLLVYGASGGVGHLAVQLARRLGARVLAVASGSDGVELVKRLGAEKAVDGRGGDDVAKAIRDFAPDGLDAALVLAGGEGRAPALQAVKKGGHIAYPNGVEPEPRAPEGVKLTAYNGESNADVLARLNRLIEAGPFHVEVFQVYRLDDAGRALEAARKHHLGKLALRIH

SEQ ID NO: 16465 - protein, 429 aa, Myxococcus xanthus
MLTDEPATGEEELPAGAQEGDGSTRIVSLDSLKRQRNKGVALAPEGADQEELNEIREGATRSNLQALRPVSQGQSGSRPAAIERSAPAAPPAKRPSSSPPPARARPAPSASGGGGLSAAERARIRRESPGVVSSAKLFWADASQGVRTGIIGGGVAMVLALFGVLYWLVLSGEDGQPVGEEPSMLTGQPIRDSFGLGPGVTWDRPDMKVFEWEYTAATRAVVILHYQAQSISKDEVVVSVNGVDVGKVPPDTLASQDRSIELMIPAQHLKKGEPNRIIFDNVKNPPGEDPWVIWNIWVERALLPDLLPEELVREATEYHKRGLKHFQTPDIGARNRYEAWKSFRVSWLMLEAHPEPKPDLYYDAQERMKAAQQELDRTCSKLLLEVEGYYNQGNYKSASATLDHVKEYFPEFDQPCATRADAKRAEYGL

SEQ ID NO: 16466 - protein, 309 aa, Myxococcus xanthus
MSNVHERLRRLLFLVPYVSKHPGVTVDALARALNISREDLLEELDLLTCVGRPPFNPDDYIDIYVDNDRVYVDLDQRLFAPPRLTPGEAAALAASAELLRPATGDALQSALQKLERVLPPATRERYREMYRKIDASTEAPQALGPLTRAIIERLEVTFGYASPGRSPEPRTVRPYELLSHRGQWYLQGYCHTRQDARLFRLDRMEDILVTDVSFQPPADARADVPNPARGLTDSSVRVRFSPVAAPYVKERFGQDARPLADGGVEVLVAGDSERWLTQWVLSFGGEAQVMEPASARAAVARAARASVGL

SEQ ID NO: 16467 - protein, 206 aa, Myxococcus xanthus
MELGSVHEGQEKEISARLEQLWDACAARKWVDLTYASPKQAGTTQRRVDPYGLALRRGAWTLVGYCHLRKELRTFHVHRIRELKVNTARPRTPDFQVPADFSLEAHVAYFPWQHRFHEQEEVVLHLSGTLASRAASLLPGATLEPAEEGAVRARLPVTFVDGLMRFCLALGPDCRVEGPERAQARLREMASRIVSCHDDSLDKVST

SEQ ID NO: 16468 - protein, 177 aa, Myxococcus xanthus
MQVTPEVLALATGTSSGVGTGGMSTKVRAAARASDSGIHCVITSGAVPGRLRAVLEGADVGTHFEPTGSRRSARAAWIAHALRARGTLTVDAGAREAIVTGKRSLLPSGVRGVEGDFGRGDPVDLVDAEGAVFARGLAAYDANELRRIAGHRTADIEAVLGYRYLDEAVHRDDLAVL

SEQ ID NO: 16469 - protein, 335 aa, Myxococcus xanthus
MRGSVIGSGSFGTALANVLAVNCEEVRLWGRESSVVEAINTQHENPTYLKGIPISERVRATNDLQEALVGSELVVLATPSHATREVVAKAQAYLPRHVPIVTVSKGIENGTLLTMTELLEDCLPEEFHPYLAVLSGPSFAKELARRMPTVVTIASHWDKVALRCQKALQTETFRSYTSTDVVGVQYGGALKNVIAIAAGMADGLGMGHNARAAIITRGLAEITRLAVRKGANPLTLSGLSGMGDLVLTCTGELSRNRHVGMELGKGRKLPDILADMKEVAEGVKTARSAHELELKTGVELPICHQVYLIAHEGKSARTAVVDLMTRHPKSELAGV

SEQ ID NO: 16470 - protein, 176 aa, Myxococcus xanthus
MGPARVAGGVLRRVDVLAGVDSAYGLMSELRVGARWMVLDGGPRWSVGVAVEGSHAFFLRPASVEDRGARYYSGRRNWNVLPGIVGNLQLPGARSPRLFLDVRYLMALDTEPIQGVPLGGLPPDVELSGAFPVRLGAEIPVSEKTSYALTIGGDIRTRPDETDFMPVITFGVVTGF

SEQ ID NO: 16471 - protein, 296 aa, Myxococcus xanthus
LYGLCMRHAASTPHMLNHKPGAEGIDPAVFSGEENVIVDFRYSQDARLTWWFDHHASAFQQPGDEAHFRADTSGRKFHDAHRKSCTKYLADVARERFGWDASPLAELIHWAEIIDGAQFPSPQMAVALEEPALRIMTVLEANKDPSLIPEVIRRMQSESLADIATSPLIAAPLAPLLARHQSNIELVRARARYERGVVFFDLVDEGVDSLNKFIAYALYPDARYTLWVGKGASRAKVSIGSNPWKPELRRHDLSAIAGRYGGGGHPVVAAVSFKADQADKARAAYAEILAELSSDA

SEQ ID NO: 16472 - protein, 133 aa, Myxococcus xanthus
MQPLAVCRSDGAAPLDASRRYFEEGRFEDALSCAAQAAALEPDLAAAHAERGVALAALGRETEAQLAYARALAIDPGDPSALLGSAHLYAVQLSSTRERGRIGRPLRRARLVPAQHAPGADSAPRAGGRHGLQ

SEQ ID NO: 16473 - protein, 221 aa, Myxococcus xanthus
MAFNDLGQAESSLAHSAIVLARNPGSREALYERALALFELCRFREARTAFTSLVDDPERAAHAHHHLGLLLEREGKWKQAQGHFDKARTLAPDDFPEPPLPAEEDFRAEVVRAVAELPKDMRGDLDGVPVTAEELPADADLLANQPPLSPTILGLYRGPPLAEPCDGSEVPCRSVVLYRRNLARAARTPEELREQIRVTLLHEIGHLRGEDDEELAARGLE

SEQ ID NO: 16474 - protein, 395 aa, Myxococcus xanthus
MPPHAALPVARVTPKGARSLRHFNPWVYRTEIAAPPDVKGAGAVVLVVDSQGNPIGQALYARRSPLALRLLTRKGPAEEPVDDAFFRRRLEAALARRAYLSGRDGLRLVHGEADQLPGLFVDRYGKGLTLQTLSEGMDARKETLAKMLVELTGATHVMCRDDASGRDFEGLPREARLLHGEGAARFTYHEGENRFEVDLQGDMKTGAFLDQVDNHLRAGELARGDALDLFSYHGGFALSLSRTCTSVLAVEQDEKAAARAKANAEANGRANVTVENANAFDVLRRFDTSGRRFDTVVLDPPGLAKRREGLATALRAYHELNLRAFRCLKPDGLLVTCSCSGKLDRAAFEEMVLAAAADAKRPVQILERRGAGLDHPVLAGLPETEYLKALYVRAL

SEQ ID NO: 16475 - protein, 792 aa, Myxococcus xanthus
MLEHGSGIMGLPLRLLAREVYDRVTARVGEGRVALMTGEEKRVPPRPDYWICTVEAMPTDKSVDFLAVDEIQLAAHRERGHVFTDRLLHARGRKETWFLGADTMRPMVQTLIPHASVKRATRLSQLRYAGHRSLKSLPPRSAVVAFSADRVYELAESLRRLRGGVAVVLGALSPRTRNAQVAMYQSGEVQYLVATDAIGMGLNLDLNHVAFAALSKFDGADQRELYPDELAQIAGRAGRHLNDGSFGTLNTLPELPPRVVSAIETHRFPAVRSLIWRNAALDFSSPEALLDSLARAPGHSAFIRVERADDFDALKDLSRVPTIQDLATGPAMVELLWQVCQIPDFRKGLFGQHVALLRETFLQLTAGDGKLDAVWLNKQVAPLDDVSGDIHTLMDRLAAIRIWTYISHRPGWLHEAEHWQERTRGIEDALGDALHERLVERFVQRAARRSTRRFVKATARPPSGSASPFAKLGQMLEEMPGAEGFAMTEEQFVQRVVDASHDAFQVDASGAISFEGEPLARLVRGTDRRSPLLALAEPEVWTGGARQRLERRLLALARDLVTEAMGGFPSESFSGAGRNAAARGLAYRLSEGLGVITQGEAHEQWRLLDEEARARLTEQGVCEGHRFVYVAEALSPHALERRCMLTSLFLQRTCPTGVPREPVLQLSELDRRDARAYGYEVLGSVVLRIDIVERLCEALRHPHGGRQVQALMQDLRLEGSIRARVLRELGGAIGNPPPRRRRRRRGGAAQVSGTSGAHPGSPRSGASERKGRRPREGAVRNATAFRDGPSES

SEQ ID NO: 16476 - protein, 691 aa, Myxococcus xanthus
MDLSKLNPPQREAVVTLEGPLLVLAGAGSGKTRVITHRIVHLLNERPGLIMARNILAVTFTNKAATEMKERLVHMAGPRAQGVLVCTFHAFGAEMLREDIHRLGWPKKFAIADMGDQLANIRRAMREHKIDDRSFDARKVLNLISKAKNSGKAPEPKPEGIGDDYDLITHMVYPDYQLSLKAQGSVDFDDLLLLPARLLREHPDLYEKYTKRFRYLLVDEFQDTNTAQLELLKLLAGRSRNVCAVGDDDQCIYSWRGAEVRNILDFDRLFPGGKEVRLEQNYRSVQTVLDAANAVIAKNPERKAKQMWTDRTGGTKVKVVTCPNDEEEARFVAHEIQKHMALGISADDIAVLYRTNGQSRPIEETLREKNIGYEVVGGSEFFDRREVKDVIAYFKVIVNKLDEISLLRIVNVPSRGIGDVTMERLNVHARGEGVTLWTVMKKATDYEDLPPGAGARVMDFVDLVERYRAAYEHGQLANVTRKLLEEIGFREATRAHATSATAADKKLKGVDGVLNSLENFEKREGPKASLPTYLNRLSLDTRQEEEEVPGANRRVTLMTVHASKGLEYRLVFFIGMEEDLMPHGGMQGEAQNLEEERRLCYVGITRAKEVLYLTRAATRVKRGKEVPRTPSRFLEDLPPEVIEVVELDAPRQGPPTTEEKNFFANLKERFKKPAIPGTPPGGTGPSGGAAR

SEQ ID NO: 16477 - protein, 148 aa, Myxococcus xanthus
MSQKTYSAKAGDIKRQWHVVDVSDKVLGRAASQIATLLKGKHKAIYTPSIDTGDHVVVINAEKVKVTGTKEQDKMYYRHPNAGFPGALKITNLEKLRQRHPEDIIINAVRRMLPRNALGRQMMTKLKVYAGDTHPHAAQKPAAFEVEA

SEQ ID NO: 16478 - protein, 85 aa, Myxococcus xanthus
MILSQPLEILEQKGKVDVTVNVKGGGLSGQAGAIRHGIARALCSFNPEFRPALKKAGFLTRDARAVERKKYGQPGARRRFQFSKR

SEQ ID NO: 16479 - protein, 461 aa, Myxococcus xanthus
ELNEILQIALRGGASDIHLKAGLPPMFRVDGSLVPLKDGRRLPPEEVARMAFGIMNEFQKEKFKGSNEVDLAYGVPGLGRFRVNVFQQRGTVGAVLRVIPFKVMTIQDLLLPQILAKICGEERGLVLVTGTTGSGKSTTLAAMIDYINANETSHIMTIEDPIEFLIRDKRSIVNQREVGVDTMTFAQALKSALRQDPDVILVGEMRDHETIETALHAAETGHLVMSTLHTLDATETINRIVSAFPPHQQKQVRLQLASVLKAVVSQRLVPRADGKGRVAAVEVLRVTARVREMIEDKDRTKEIHDAIAQGTDTYGMQTFDQSLMSLVRQGLVTYEEAHRQATNPDDFALRFSGISGTSDSKWDNFDSKPGESRPIPGSSAFAQKGAPTAVAAPQAAPAPAPMAQPMRPAAPAAQQMRPGGPPQAMRPGAPAGAPVGRPMGFTAVRPAGARSGPRSGRGGPR

SEQ ID NO: 16480 - protein, 174 aa, Myxococcus xanthus
MDGLRLPYRAEAPGVDEVVAPHLSVTEAVRELASRKARAVHQRHPEAWVLGADQLVEVAGEVLSKPVDRNAAREQLRKLVGHTHAIHTGVCLVGPGGKVLDAVETTRLTFYRVKEEELERYLDLNEWEGCCGSYRVEDAGQALLERLDGDRSNVQGLPMVTVVRLLREAGFRFF

SEQ ID NO: 16481 - protein, 100 aa, Myxococcus xanthus
MFCKDCDSCFSCTHCTRCELCNNCSHCVDCKSCNACAYCVQSENCSTSAYLVLCRNLQDCNYCFGCVGLAKKDFHILNVPFPRTEYFKIVGRLRKELGIP

SEQ ID NO: 16482 - protein, 91 aa, Myxococcus xanthus
MGERIGKAIQEAADRSRGKAASDPSAPIHLDDAVGFVRYDAEESVAEANLLVGGRYVVAVTSRGFPGTVEVRRVARGIDLAGLARLRPGPN

SEQ ID NO: 16483 - protein, 76 aa, Myxococcus xanthus
GLRRISAGKAKSGEKGYLVDADRRAAIEQAISLASADDVVLIAGKGHETYQQVGEEKLVFDDRQVAAKALANRIAG

SEQ ID NO: 16484 - protein, 466 aa, Myxococcus xanthus
MAASFSDEEVVQATGATRRGGPAPAAYATVCTDTRALTPGCLFVALVGERFDAHAFVDAAAKGGAAGAVVARGRPLPALPDGLTLYEVDDTLRALGALGRHHRQRFRIPVCAVGGSNGKTTTKEMVGAILATRGPALKTEGNLNNEIGVPLTLFRLEPRHVAAVIEVGMNQPGEIERLARVVQPDAGVITVVQPEHLEGLGSIEGVAAAEGELFQEMGHGTTIVVNVDDALIPAQAERSGAQRLTFGRAEHADVRLADVKTLGREGMVATVRHLGREWPVRLHFVGPHNAQNATAAFAVALALGYTPQECVRGLQSARPYSRRLNVVDGQHGVTVIDDCYNANPASMDAALETLGTLVPASGRAVVVLGDMLELGPGELEEHARLGGQIPSHAALAAFFGPRSLKGWEAASMGESAAHFTDVEPLMAWLAPRLREGDVVLVKGSRGMRLERVVAALTGTAAPGGNH

SEQ ID NO: 16485 - protein, 316 aa, Myxococcus xanthus
MGGALILLCIAAGTLLFADLKSRAVWVMLLLTLGYGFIGFLDDWLKLSKRNSKGLAGRKKMVLQTFFFLVAVFGLLTTWTLPDGSFGPTLLINTKLTLPFIPTRWFNPDLGWFYVFFAWIVVVGTSNAVNLTDGLDGLAIVPTIVSAITFAVLCYVAGTTLSIADYEVVGGASKLVATPLYQYLGILQVPGGAELAVFCAAIVGAGISFLWFNTYPASVFMGDIGSLALGGALGGLAMLSKNEVVSAIIHGIFFAEILSVMIQVTSFKMTGKRVFKMAPVHHHFELKGMAEPKIIVRFWIVSILCGGVALLSLKLR

SEQ ID NO: 16486 - protein, 564 aa, Myxococcus xanthus
MVLGGTIAFIVAWGLWKSRGTATSDEYLRGGRELKWPTIGLAVMATQASAITFLSVPGQAYEDGMRFVQFYFGLPIAMIIISAVFVPIYYRLNVITAYEYLESRFDLKTRLLGAFLFLIQRGLAAGITIYAPAIILSAILGWPLEPTVIVMGAVVILYTVTGGAKAVSQTQKQQMVVMMGGMVVAAIVIVWRLPEHVSFGKAVDVAGAFGRMNVVSFDFDMQDRYNFWSGITGGLFLSLSYFGTDQSQVGRYLSGRSISESRLGLLFNGVLKIPMQFLILFVGILVFAFYQFNTPPLLFNEALRTRVQGTAQAAEYAALESKWEQVQSGKRAEVERYLSAVDSGDVAAGAASRALLQGRAEEASAVRKEAKDLVSRALPGAETKDSDYIFISFVKRWLPSGLFGLLIAVILSAAMSSIASELTALGTTTTVDFYRRVFQRNASDRHVLVASKLFTVFWGVVAVGFATFASLLDNLIQAVNILGSIFYGTVLGIFLVAFFVKHVRGHAVFAAAVISQATVIALFFLSDVGYLWFNVIGCALVVALSLVMQAVLPRGETPAPAPGA

SEQ ID NO: 16487 - protein, 114 aa, Myxococcus xanthus
RLRSWWWVLVLLTVSCAGRRSSSEDLGGRDARSELFRARGDAAIETKQWALAAGYFASARHTEDSPTARWGQVWAEKRASSLEWAKQIEGSVLALAFSPDGRLLASGGYDAVLR

SEQ ID NO: 16488 - protein, 455 aa, Myxococcus xanthus
MTLALSGQKVLVFGLAKSGVAALRLLRQQGADVTALDARGEDALGAVAHEVKALGATRVSGPTPPGLLASQDLVVVSPGVPLALPEIQAARAAGVAVWGEVELAGRMLSGVPLFGITGTNGKSTTTALTGTLFASGDKRTFVGGNLGRPFSEAAMSPGDWDALVVELSSYQLEGIRTLRPRGAAILNLTPDHIDRYPSHAAYGEAKARIFQNQQAGDFVVVNADDADVLGLARAAKAPVYGFSLTGKPVADAPALAGLAVVEPGGFRLAFLGEHYTLTNRALRGAHNAQNAMAAALLARLGGVASGAVQAGLDGYPGLPHRLESVRVLDGVEWVNDSKATNVDSVLVALRAFSQGVWLIAGGKGKGAPYAPMVEAGQGKVKGVLTIGDDADTLARAYAGAAQVHACGTLAHAVARARELAERGDTVLLSPACASFDQFKNFEDRGDSFKRLVEAL

SEQ ID NO: 16489 - protein, 388 aa, Myxococcus xanthus
MKNPSPPSSALVRFDPVLLCAVLGLVSFGLVMVYSASAVLAQDKLGDSLYFLKRQLVAAGLGLGAMAVAMKVGWRRLARWAYPLLLAAIVLLVLVNIPGIGSTAGGARRWIRLPGFGLQPAEVAKFAWVVYLSYSLAKKREKVAKFSVGFVPHLALCGILVLLCMMQPDFGSSVLLVFMLFVLLFAAGAKLSYLVGMVLLALPLAYVAIASSPYRMKRILAFMDPWAHRHDVGYQVAESLMSIGSGGVVGLGLGDGRQKLFFLPEAHTDFIFSIIAEETGLIGVGLLVVLYGVVLWRGVRASLAAGETFGTYLGLGISSIIAFQAAVNMCVAMGLLPTKGLTLPFVSYGGSSLVVLMGAAGVLLSLSANTQGVARPSRVGTDMREVAA

SEQ ID NO: 16490 - protein, 383 aa, Myxococcus xanthus
MMKVLIAGGGTGGHLFPGIALAEEVVTRHHRNEVVFVGTERGIESRVVPKEGYPLELVKVQGLKGKGFLSLLKALFALPLAFIESFRILARQKPDVVVGVGGYASGPVVMAAWLMGIPTAIQEQNALPGFTNKVLGRIVRVVFIAFEEARAFFPEKKVQLIGNPIRRKLMDNYLRSHVAHERFSVLVFGGSLGARGINQRMTEALDSLGDLKDSLHFVHQTGKNDLESVRKGYADKGFQAEVVEFIDDMSSAYARADLVVCRAGATTLAELTVCKKASILIPFPHATDDHQAVNARALVDAGAALMFRESELTGEKLAQTVRELKSHPLRLKSMEKKAGLLGRPEAAKELADVCVDLMVQTWGPNGRERTPIEAEKKAPRSNS

SEQ ID NO: 16491 - protein, 445 aa, Myxococcus xanthus
MSGIAEVLLNLGYRVSGSDLRESDITRRLVRMGATFFEGHRAQNLIQADVVVISSAVRKDNPEVVAARQRKIPVIPRAEMLAELMRLKYAVAVAGSHGKTTTTSMVATVLSAAGLDPTAVVGGKVNVLDSNAKLGKSELMVVEADESDGSFLHLHPSIAIVTNIDPEHMDHYGDLDTLQSAFVEFCNRVPFYGLNVLCLDNPNVQALLPRIEKRFVTYGSSHMADYRLENIQLDGFTTRFNAYRREESLGEFRVRMVGAHNAFNALAVIAVAEEMDIPLETVRESLAEFGGVQRRFTVRGEAQGITVVDDYGHHPTEVLATLAGARRAFGRRVVVAFQPHRYTRTHDLMKEFTTSFNDSDVLFVTSVYAAGEERIHGATGDALADAVRAHGHRDVTFVEKRTDLPAALLPRLREGDLVLTLGAGDITHVGPELLELLRTTPLAKD

SEQ ID NO: 16492 - protein, 310 aa, Myxococcus xanthus
MVEAGVKTALAARVESLGGCEVKAGEPLAPLTSVRAGGAAEALVRPRSPDALVALLKLAREEGVPVSILGGGANTLVGDGGVPGLTLKLPGDLFPEVADVGPEEGRLTLGAGAAIVRLINVMRAHALVGAEFLAGIPGTLGGAVSMNAGTKNGEAFRVIEAVEVATADGVGWLTKAQVPYSYRHSELPPGGVVTRVRFALRKGDVVASKAVMDADLGYRKRTQPLSQPNFGSVFTNPPGDHAGRLIELAGLKGYSLGRAQVSTLHANWIVNLGGATARDVLGLVTLMQQRVLEQSGVDMKPEVKRLGDFL

SEQ ID NO: 16493 - protein, 294 aa, Myxococcus xanthus
MSAERDVSLRTGEAVSGALRGLGYDVVEIDVGRDLPARLAAEKVDVAWLAVHGRYGEDGCLQGLLESLFIPYTGSGVLASALGMDKVYAKQVYVAHGIPTPAYRSFKDAASALAAADSLPFPFPVVVKPSREGSSVGVHICKTRDAYEAAVTDAAKYAGTLLVEQFVKGREVQGGVLDDEALGVIEVRAAREFYDYDAKYKAGTGTQYLFPAPLPPDQYARVNEVCLAAHQALGCSGGSRSDVIVTDGGDVFLLETNTLPGMTASSLLPKIAAGRGIDFPALCERLLLGACLKA

SEQ ID NO: 16494 - protein, 154 aa, Myxococcus xanthus
AFGKSKNRRRQDAAQQKEAVRGAVRSHGPGVLKVLGLTLGTGLLVWGGVALREWALTSPRFELEAVSFSGLQRASRVELLRLAALTKGQNLWTLDVDALERAMHQHPWLRTVEVTRRFPNRVSVEVTEHVPVAMAVLGELYVLDEEGEPFKRVI

SEQ ID NO: 16495 - protein, 77 aa, Myxococcus xanthus
LDAAHRERGWHQPGEHRQALAAGITFRPASDTIRDTVAWFKTLPPERQAKPRSGLSAEREKEVLAAWHQERGTANAG

SEQ ID NO: 16496 - protein, 499 aa, Myxococcus xanthus
MTPDLLKDAVSPILRARGTSVLLAALLAACGGKDVRPEAPPAGDCAPLRLERDVNLEGFRTDRFEWRDADCKPRSASLVRNDATDPKGWTGGYLRRYTYEVAGATRVCDGSDGMVPGWGIVTSHLRVSPPWGNWTEGIRGTWRTLFEGRHHALHEFRWPMELGGHVVDVTVHYLFATGRSHPLYAITHDASGAPPDVINADVRSPYGDIIFDGDGNADISGVGWGDRYRFVTLGAGPLTRASGWDYREPNVVPYTRMWIASPDAEMGVVQTQTWVQKPAGGYWQYPSWGQVDEDGPMPEDWNWTYQLNQYELPEQGPTRSHRMAWGSNFGAVGFREYPRYSDDAMLSGYPYQSYSVFMVLGTHTSDPVLRLAADVEAWQGVRLTATEGRVLDRGPGGVGRDDSVARDVPGYNPVYATWEAEVGANNRASLRFETNGRALVNPVLVLRGYTASTPPTRVTLDGQALSADVDYFASVDDAGNALWLTLHRTVTGSAALLVE

SEQ ID NO: 16497 - protein, 1394 aa, Myxococcus xanthus
MNLSRLYTLAHGGHGEMLSVGRVQTPTLAMVVERELAIRDFVPRDYLELVATFAPRAKGVPPDALYKGTWFRSGPDGKPVAPPGFEGVREARRLDANGVEAQAIIDRVRAGRAIIESLESEEKRMAPPLLYDLTELQRHANRLHGFSAQRTLEVAQALYEKHKLLSYPRTASRHLSRTVADTLPEVVNAIRGPYEEDLAVGTGARALGKRYVDDAKVTDHHAIIPTPTAPGGVRLSPDEQRVYDLVCRRLLQAWHEDHVWRVTTVITAVTSAGAPPVVDRFQSTGTQVEQVGWKVLDIGGGQKAPRLKSEGRKGEDAEREPEDEPQTLPSGLARAQPQSVEDVEAVKKRTRPPPRFTDATLLTAMESAGRALDEKELADAMRETGLGTPATRAAIIEVLLDREYLRRRGKVMEATEKGIHLIQVVHPDVKTPAMTGQWEAWLQRIERGEGQLDEFIRGIEAYVIEVVGHGATAPQRPPRNEVLGAPPGAGWGQGGAAQVASEGAAAAHGAGAGARGPGGQGAFAESSAERFGDASAGGAGRGRQGAFTEASAERFADAAPGVQGQGRPGALSEASEPLFGTRRSRTSGSVGRSEPHGEPLSSTMSPGGGAASRLPRADGTGWNAGAWENTGAARAPVNRARTPASAASTGQRPERVRRAPTAPEALRPLLKEAFGFSDFRPYQEAVCRAATAGEDLLLVMPTGAGKSLCYQLPGLARAGTTLVVSPLIALMEDQVARLQSLGFAADRIHSGRDRAMSRQVCADYLEDRLDFLFIAPERLGVPGFVEFLARRTPALIAVDEAHCISQWGHDFRPDYRLLGARLPLLRPAPVVALTATATPDVQRDIVQQLGLQGPGGKARTFIHGFRRTNIAIEVRELNPGARGDAIQGLLEDEENRPAIVYAATRKHAEQLADQLAGEFPAAAYHAGLQPSERDRVQAEFLRGSLEVIVATTAFGMGIDKADVRTVIHAALPASLEGYYQELGRAGRDGKPSRAVLLHSYIDRRTHEFFHRRDYPEAYVLERLFKSTAPQLEPKAVLQGRVRGDPEVFDKALEQLWIHGGVVMTPDETVMRGKPGWSASYSAQRDRKLLHLEQMGRYAEAHGCRMKQLVGHFGDTQDSGEPCGLCDVCAPEDCATLRFAEPTSAERHWLERILESLQERDGQATGRLHRELFGESLPRRDFERLVGGLVRAGLTRLEVDSFDKDGQVISFQRLALTDEGRRTRAVDPQRVVLPLPLEKAAKRKRGKGAEKGTAKRATAKKRTVRAKAGAATRRTASESDEEDSPTHWRANAPSKSTAGAPRASRSTGAPSGSASGRRAAAEPSPKMVEALKAWRLAEARKRRVPAFRILTDRVLEAIASACPENGSELMAIHGVGPSLTERYGAQILSLVARRS

SEQ ID NO: 16498 - protein, 511 aa, Myxococcus xanthus
MGGPDEQADSFAEQAELESKSVEQESVEAQWKDAEKKVYSENFGKGAGPEWSHRTVSRTPNGERKFLGPFSEQEVTLSLAGLPDHDEVEVQLELFVLKSWDGNDTTKGPDRWVASVDGGPVLLDATFSNDDAPFDARYGQSYPKPYLQGSHPGLTGASMKGKLGYRDESGDGSKGYAIYPLSFTFRHTGDRLTLRFADPPRGEANKQWGLDSVKVKVRKKKKGGDLLVSNNVNSSVLRYDGKTGDFVGVFIPPGAGGLNNPQELVYGPDGNLYIASFASREVLRFNGKTGAFIDIFVPVGSGGLGFPGGLIFGPDGNLYVADSFGGTNSVLRYDGTTGAFIDVFASGGGLLVPQKMAFDKKGNLFVVSIIGNNVVRYDENGAPFPAAGQPGAIFIPDIDAVTIATGKNHKLYVGTTAGDDVLRFNAKTGAFIDVFVESGSGGLTDFVDMEFGPDGNLYIPDFLPATVLRFSGKTGNFIDVFVPAGSGGGANAATLTFMPSKRNKPHGREAN

SEQ ID NO: 16499 - protein, 25 aa, Myxococcus xanthus
MLLPQDSRGYRAAKETFWRVRRALL

SEQ ID NO: 16500 - protein, 272 aa, Myxococcus xanthus
GSPPLTEVGTVLARGIADGPDEDFETLRTVLLGALATARTSVRIVTPYFLPDTALITALSVAALRGVQVDILLPEKGNLPLVQWAAWAQLWQVLRPGCRIFLTAPPFDHTKLMVVDGVWSLIGSANWDPRSLRLNFEFNVECYDTALAMQLEGVVAARLRNAGPHGWSRWTRAPCPSACGMGWRGCCRRTSRAERAGPARRSPWRHGSPASPGAAACAAAPRTASAGAAHNASPPWHAGSPAGRACGSPRNRSAARCACAPARCPRTWPHRD

SEQ ID NO: 16501 - protein, 200 aa, Myxococcus xanthus
MKPTYTVAAVRNQDELEHILALQQKNLKQALSADEMRSQGFVTVQHDLPALEQMHAMAPSIVARHDGVLVAYALTMPREARALAPVLEPMFALLDSLEFRSKSLRDYRFYVMGQICIDKAHRGQGLFDRLYHQHRDHFRDQFDLIVTEISVRNLRSLRAHERVGFETIHTYRDATDEWAVVAWDWAPPRPPDVTPEGNTR

SEQ ID NO: 16502 - protein, 112 aa, Myxococcus xanthus
MNGRFYNFQITECFGERTERVSEPHNHRGTNADAAEVRAHVEAFVNAAARFGTLDPEVKAAGLANLNTLIEGRSFFGCSYGYARDPWSGHGATFFVDTESGFSVYTDSYWAE

SEQ ID NO: 16503 - protein, 126 aa, Myxococcus xanthus
MHYLSLTAEFKASHAVTFPDGQREPLHTHDWWVRVWVKARALNHWDVIIDFKDLQDIIVRVCRELHDTNINEHPYFKTVNCTAERVTEYVFKQVESGLPEGVTLDRVHLRRTGGELPEAEYAHARD

SEQ ID NO: 16504 - protein, 69 aa, Myxococcus xanthus
MTVLFVTHSIPKAAYLAERAVVLSRRPARVVLDRTLELPGERSASLRTEASFAREARLLNEALEQGERW

SEQ ID NO: 16505 - protein, 173 aa, Myxococcus xanthus
MVERALYPYTLFLQTVPIVAIAPLLVLWFGPGPRAVAVSSFIVSLFPVIANTLTGLRSVEPSLRDMFRLYGARRLATLWKLELPAAMPHLFTGLRIASGLAVIGAIVGEFVAGFSEGTAGLGILVLAAYRQLRTDLLFAAVLAASGLGLVLFGVVSLTGARLLRRWHPSAQGT

SEQ ID NO: 16506 - protein, 249 aa, Myxococcus xanthus
MVATGKVEFGISGADELLVARARGLDVIPLFAVYQTSPHAIMAHASRGAKNIADVLSSGTVALEPGLSYVAFLKKKYSFDKVKVVPYDGGVARFLADKDFAQQCFVTAEPIAAKRQGATPTVFLVAEEGFNPYLAVVITRRQYWKEQPERVKSFVAAVREGWRTYLDNPGPTNAVMGKLNTTMDAETFAEGAETQKPLIETEETRARGLGTMNRQRWEQLAQQLVELDLIEKAPAADEFLLPEFTGSRD

SEQ ID NO: 16507 - protein, 166 aa, Myxococcus xanthus
MRKSIDGLMSLVRTAAHRELRQLHSAPVLTQLHVWLETQAPRHLPKSPLGQAISYALKQWEALTRFIENERLPLDNNRAEAALRKAALSRKNFLFVGHEAAGENLEGLYALVATCAANGVNPETYLTDVLLRAQTHPNSRIGELLPHEWKCRRVAEPPDSVLQPSP

SEQ ID NO: 16508 - protein, 100 aa, Myxococcus xanthus
MIADSPEMIAAMKQMGQPTSHATRSRFTEVAPHSRLVLTNVIDFLPGVAPYESKIAVDFLPSGDGVRMVVMLDAMHSEEFTKMQQEGFTSQLTKLDSRFA

SEQ ID NO: 16509 - protein, 242 aa, Myxococcus xanthus
MAQNIYDDPGFFEGYSQLRRSMEGLAGAPEWPALRAMLPELRGLRVMDLGCGYGWFCRWAREQGALQVHGLDVSARMLERARQLTSTRDIVYTQADLETVELPRASFDLVYSSLAFHYIEDLPSLLAKVHATLVPGGALVFSTEHPIYMAPTHPGWRVDEQGQKTWPLNGYQAEGPRTTDWLAKGVLKYHRTLGTLLNALIHTGFSLRQVNEWGPTEAQLSAQPELAEERERPMMLLVSARR

SEQ ID NO: 16510 - protein, 53 aa, Myxococcus xanthus
ARAAGLLRLAVVSPRQVTRVERTTVRHCAQTRDGSLYVLSTATHDNDTPVTMI

SEQ ID NO: 16511 - protein, 49 aa, Myxococcus xanthus
MYDLYELNGIRTGHVMNLLLYHLLDAVFIYNPAVLRTQSETAHVSSALR

SEQ ID NO: 16512 - protein, 66 aa, Myxococcus xanthus
SKVLWFAAQLNVKGDGGLPFDVPQRLGKARRTLVELRDPAWRSYLAWFEIYAALAAPAAEEARSAP

SEQ ID NO: 16513 - protein, 87 aa, Myxococcus xanthus
PLLGEGAHGQGAGCPELAQELSEFAAEEVDQAACVRLEDHLSRCPRCSDACDALKRTVSLCRRIPGDEVPAPVRAAVRQALSRALPA

SEQ ID NO: 16514 - protein, 55 aa, Myxococcus xanthus
MVVLTTVMPMAIITTTWFLPPGWNLLGTAAMLTGFLLVLGKAIAGVPLALLISEL

SEQ ID NO: 16515 - protein, 46 aa, Myxococcus xanthus
MEEYFRRFVMEHQEHMGETELAKRLGISRKALWEKRQKLGIPRTRA

SEQ ID NO: 16516 - protein, 82 aa, Myxococcus xanthus
NNTTALIMYTFDMDAMPFLMVDHVSRIVPLERKSMWYTLLKRAHDPDDTSLPCRLYQKVVDKSIWRRHAVALKHCGQRTSEL

SEQ ID NO: 16517 - protein, 36 aa, Myxococcus xanthus
MLYSCSDHGVGLRVTLRAVLSVFLEAVPTTKTLSYG

SEQ ID NO: 16518 - protein, 102 aa, Myxococcus xanthus
VRVLGLCAGAVDFVFGSASMAGLSARIVSVVRRPGASERVRELFARCTSVAVVEVILLSAGAVVLSGESPEVALLFAGVGHLLRPGGCPSLHSRWWGFSGWG

SEQ ID NO: 16519 - protein, 120 aa, Myxococcus xanthus
SRAHILTELRADVEDSWDRLMGPLLEAELRSELKERADQQAIGDFGENLRHLLFTPTAGARAVLALDPGLSTGTKLVIMDVTGNVVETMTLYSERGPDERARTGKLLAAEVHKHKAGTRR

SEQ ID NO: 16520 - protein, 482 aa, Myxococcus xanthus
MLLPLVIFTSGSAALLLGTSGLIPALWGRYLLGSQLTLVGSHCILPALAWFISDSVLENRMRWFRWSAWAACVPASLQVIIVMADLGMAQRNLGLFVLYSVPCLLGCVIVAGISAWRGNPDARIFSMGLGVFFGVVIHTTLPVFGLAEATDSLMHWGFLALTLSLVGIVVRRSVLVVRALASHTHQLEERRHEVKRLAQDMGSGAGELATVAQQLRTSSEVQTAGVSRQAAALREAEQTVQEIRQGSLVTANKARQLAGSIETAEEAGRDGGAAITHTLTNLEAIRQEVSEMSSHILALDARTREISSIVDTVKGLADQSNMLAINAAIEAARSGEHGRGFGVVSREVRSLADQSILATHRIREVLDGVSLSMREAAKRSEQGEQRVKASLDAVRVSGTQLQRLTGIIDDTGTNVRQISAAVAQQDAGTSQIAQAIQELSAQMRHTLRTAEETQKVSGSVQALAENMAGTARIALQTGTLDD

SEQ ID NO: 16521 - protein, 105 aa, Myxococcus xanthus
PYSGGHTDGANLVVDMCSDSSREWVLHSQEVLQAFPHMLCNQDLYARGVYADLPIPGRPHDVDLSTADRTGEGLLNMAPIFLVIPNFTGWMQVASYSIARELEPI

SEQ ID NO: 16522 - protein, 45 aa, Myxococcus xanthus
MDILDEVDRLDNDNLDLNEAGGPEVEINVHSFVADCILGPFRTLG

SEQ ID NO: 16523 - protein, 42 aa, Myxococcus xanthus
EEEAPSGLFGDAVIALLEHNLLPVAVPTGKTFHSTDDETATF

SEQ ID NO: 16524 - protein, 61 aa, Myxococcus xanthus
PYQPVLEQVQPLVNVYDKLPEPDLPEDLKVNVVPHHLHRVNLLTLLREAGLGEVLADHTRL

SEQ ID NO: 16525 - protein, 95 aa, Myxococcus xanthus
LPALGELCALQRKRADMAGLADALEVRARVAEAQGDKRLAAAALRELAGVLEARLGRVGDALVALEKAARLAPDAAVLLDLADLSLLCERPQHER

SEQ ID NO: 16526 - protein, 126 aa, Myxococcus xanthus
QQTLGRRYLGARCTNPLDQDYHPGGGSLTYRKGAVHPEILDMDVLSEIMFAGHVLLDIGRMVSDHDDRIHRNLIRVGDFNDHAHAGGTAHDLTLDESSGDTNVIRAELLHSCALLGGGPRYIRAYT

SEQ ID NO: 16527 - protein, 41 aa, Myxococcus xanthus
GTNLLSCNNHSVKRYLDYQLCPESPRSNLECRLSEQACQNL

SEQ ID NO: 16528 - protein, 37 aa, Myxococcus xanthus
MQFVEYLLKGFGESKVHNLVDIQGGQLLPLLKVTLCF

SEQ ID NO: 16529 - protein, 64 aa, Myxococcus xanthus
RVHHPIQTGRRMGEDFPVRTPRETHADCGFDQDDWEVLHLENHLPEEHDLMELLDVPLQNDPAA

SEQ ID NO: 16530 - protein, 62 aa, Myxococcus xanthus
NASAALRRIGLCDEVAQAGACPTDSAILKPSGSALTRLPVTRIQEELGLPLVCVHRARLQSV

SEQ ID NO: 16531 - protein, 120 aa, Myxococcus xanthus
ANRYSDGGRADYPTHDHSDRAAPRAPPHNPSTAQHTTHVNTEAGQRHPLGHVTANALEAPERYPALPNHTNRPPGRPYHRPTADPHTPTFNPHEAHEHQLPNDNIHHLGTTDHDAGLTQA

SEQ ID NO: 16532 - protein, 81 aa, Myxococcus xanthus
MSIKSHHKEFFILQGNKVYWQYIKQVVQLISGVIRSYSVACHIRSGAPQTDDLAVWFVPQVHAQMLAQMLQSLSEKVRRGA

SEQ ID NO: 16533 - protein, 75 aa, Myxococcus xanthus
FCLCLRRTAYLACKENGDEGTALSYPMIGQKRTFKLLEEMYGRLGTLDTSYLVLPAMDHRNALDCYKGLEPLSRS

SEQ ID NO: 16534 - protein, 83 aa, Myxococcus xanthus
MRSLYAQLEDPFPVVLTVAVTVTLLLMTHPMDAAAIAQPYKLASDRVVHLSVQHAVVVVQSHPRVTSDRLLDTPEILLLFFRM

SEQ ID NO: 16535 - protein, 122 aa, Myxococcus xanthus
ASAELYDPGTQAWTTVASAAGARTAHAAALLPDGRVLIAGGRDAGGAALASAEVYDATTNTWAPVAGLAQGRERFTLTLLPAGELLAAGGSAGGVALATTERYSAAANTWTPDSPLTQARWR

SEQ ID NO: 16536 - protein, 80 aa, Myxococcus xanthus
MREVTSCNHEGMPAHIGNRSHEYHKSALDLYHALSYTNSIPLWLLTPNELMNVRGRYYLKGHGLSLVTTCNGLLYMWMTG

SEQ ID NO: 16537 - protein, 166 aa, Myxococcus xanthus
SVPKMFSLLAGVHMLGVGMFVVAHVDGQARPLRATTRPWSVLRPGALRGFRWMVFLLGAWSALFWGLQVGSSDLPLKGLSLRMATLALPAYGVLFLSLAVWLGRKVRPDRLATPVAVRLMFVASVALASALPPLVAVLMGFDGDDPILNLFNPVVGIANFATYDYL

SEQ ID NO: 16538 - protein, 167 aa, Myxococcus xanthus
ALSLLPGCATVPKPSMCFAEAGPNARSFPTPDTWFALLLHGYDKDTGANPRPSVDCAGAPVWWQDPAADECVEAGPDSQALPPAEKLSEEDLVLETLQAGQRLVWVQTRRFTNGEALGPVALVESTEQGFRVEALGSLRAMAKHTKLRLEKVKGTPILVAEGDACTS

SEQ ID NO: 16539 - protein, 100 aa, Myxococcus xanthus
GPLISARSHLKDQTDSTLGWILHTIELHDVIVLLSTLFSNMHARLRHNHELQAREAQLFQDPFDRRTETTPICQVRLMRLSSEAEVRPNKQTVEDHARLD

SEQ ID NO: 16540 - protein, 56 aa, Myxococcus xanthus
MQFAESDSLNWVRAMFQQPRMHEMTVLTVVFRYDDQKVVLHCMIGMPYTMGNMRVL

SEQ ID NO: 16541 - protein, 41 aa, Myxococcus xanthus
NYNVCVLYDLWWRTKDSVQYMHNSMTANLPKVIGWVDTDLM

SEQ ID NO: 16542 - protein, 148 aa, Myxococcus xanthus
KPFYMLKFRSMVVNAEELKEKLAALNEQTGPVFKMKHDPRITGIGRFIRKFSIDELPQFINVLRGEMSIVGPRPPVPTEVAKYETWQRRRLSVRPGLTCIWQVSGRNQISFEEWMYLDMQYIDHWSLTSDLRLLLQTVPVVLTGRGAS

SEQ ID NO: 16543 - protein, 109 aa, Myxococcus xanthus
LQRGRGVITKVPEVLFHKEGTLAHYDFEVADLAADDDFPVMVVKSMPQHGKDMLGDTNRAPSTVVELLADIDLLGHLLAVEGTILVLCRRPPLDELFHLCNEWTRCPGI

SEQ ID NO: 16544 - protein, 37 aa, Myxococcus xanthus
GKTIGNKGRSNDALLLANNMLVKARPVTNACMLTGQD

SEQ ID NO: 16545 - protein, 30 aa, Myxococcus xanthus
MKPDIIRFLRQPCGIVGAFEHADLFWLVIG

SEQ ID NO: 16546 - protein, 56 aa, Myxococcus xanthus
SKDDMVVFIHTHVDDQTELLPRGGHDLGTPVRRLLLLTPLVPEPSAHRTTHDHSDR

SEQ ID NO: 16547 - protein, 183 aa, Myxococcus xanthus
ERGLRERVPQACETSFPFQVVVDASEQLNPDARGRSLPTVVQIVQLKDSVRLERAGFKDLWGKPEEFLKEDLLQVAELVIPPGRQVKRWVQRDPKARFVLAMGHFRQPLGYSWRTVAALPVVEEARCVERPAGDQGEAKPGDEVFRYRLQGYQIDLMFRPMTQAPEPRLQPQAGDGVSPRRGV

SEQ ID NO: 16548 - protein, 557 aa, Myxococcus xanthus
MQSTLTRRPQATAFSIEDLLDRVQRGEVRLPHFQRPLRWEAGDVRDLLDSVYRGYPIGTLLFWKREAPAASVSFGPVRIDAPSHSQALWVVDGQQRITALAAVLLHPEQEPAARDGFTLFFDLDTHEIVQPAHGEPTPPHWLPLNRVLDSEQLLGWLDRYPGREKNPEHVRAAIRLGKAAREYQMPAYVVEAAEEKTLRIIFKRLNTSGKPLTDDEVFNALYGGTAGSRLPNLKALATSLLELGFGRIDESLLLKAVLAVRGLDFTQDFQKQLREEDDLTQTLLQTEAALRSVIVFLKRDAGIPHGRLLTNPLYFVLLARFFHLHPEPSPRTRDLLARGFWRGSLVDSFLDSRALSPQELLAAIGPDEEQSVQSLLAQVRPLSDEWLAQHAQPATFGLALRSRGMALNALYALQPRHLRTGALLEPSQLFSDTDPASLSPVLKSLTVQEPDAELKLDPALYRSFLYTPANYLMHPPLPGQPLLDVLRDEPAPPPEVLQSQAITPAMRDTLREGGTLEFLMQRMELIDRHIIEFLRARTRYEESDRPSLQSLVVEEED

SEQ ID NO: 16549 - protein, 31 aa, Myxococcus xanthus
TENDLQNLPEKHPILDQDTLAMVTADHAMTY

SEQ ID NO: 16550 - protein, 70 aa, Myxococcus xanthus
RDTPGLTSRPQPPDNLRSRVHAARHKLAQVRAHLVSHRFTDGLAVTSALLEEQKGLGYKPLQPQIFVARG

SEQ ID NO: 16551 - protein, 30 aa, Myxococcus xanthus
CGSEEDAMEVLQETLFSAFRGIHAFRGDAA

SEQ ID NO: 16552 - protein, 90 aa, Myxococcus xanthus
RHGMAQRLEGLREVLRAAPLKLRAAAVGQVARRLPAHALLDLTRRWQVQPVPEAPVTDLVDAAWSELLSGSRTLWYACRRSLPYHHSAVE

SEQ ID NO: 16553 - protein, 224 aa, Myxococcus xanthus
LKRESDLDFVSRLLEEEGIFYFFEHGEDAHMMVIGDGASANPEMQGESKLVFRERSQMVASQEYVHELVSRMEVQPGAVALRDYNFLRPAQDLGASSEAEDGEAALEIYDYPGRYEEPAPGRSLAKVRLEELRARAETVTGASYSRRICVGHSFELAEHPDESANRKYLPVSVRHLGHQSEALSIEQGSLRSREDYRNEFLCQPAEVPFRPPRVTPRPVIPGAQ

SEQ ID NO: 16554 - protein, 101 aa, Myxococcus xanthus
THRVGAAGLPRRRREPASLRQRLRGSILDGSYLEREDETTPLTERPIRDYLYTKVDADHTLLFENAPDFLNPVVLPILMWCDLDTYLLAEVQEDEPTPLLR

SEQ ID NO: 16555 - protein, 100 aa, Myxococcus xanthus
MKTPNALDALTAQVPPAPSPAPTPGGGSTQPGTGTPPSDSFPAGDVVGIGAAALFVLLMVLAARKLFFRKRPEEKKPPTVPPAAEKPALPAEQPRLRVEL

SEQ ID NO: 16556 - protein, 227 aa, Myxococcus xanthus
PCGVEGMMGIAYDVQVQTPASELNSEQDLAQVPLLKNASRPVLGDVATITPGIAHGETHNLGTMAFASVTANIHGKDLAQARRDVQTAIASMGELPKGVNVQLAGLSVVLDDTMRSLANGLVVAVLVVFLLLAASFQSFRLATVVLTAVPAVVLGAVISLRLTGSTLNLQSYMGIIMAVGVSIANGVLLVASAEQRRKAGANAPLAALEGVSLRVRPILMTTLAIFR

SEQ ID NO: 16557 - protein, 288 aa, Myxococcus xanthus
MEPLEEPQPPHAPQEQEPLRFSLAGVQLKFSMLRRDKAMTLPAGGRGGNWIVKLPDNRYDRVPENEFSMMTWARAAGITVPEVALLDVADIQGLPEGITLRENVAYAVRRFDRPEPGRRVHMEDLTQVLGLYADEKYKKYNYETVANVIYKVAGLDALHEFLRRLVFITVIGNGDAHHKNWSLLYPDGTRATLSPAYDLVSTLQYMPADTLALNFAKSKRFEDISLGSFERLARKLALPPSDVLPVVKSAVEASLDTWSSLHAQLPLPDESRRRIEAHWKRVPLLQGQ

SEQ ID NO: 16558 - protein, 121 aa, Myxococcus xanthus
QRTSLNQTLSGPEAEQYLRVSSNVTPLFGDASKRLLTPYAPEDVRLLDDSKGAPINPGAVERVLPAGTKLRITRVEFPTSWVITERVLYSPRAWPWVYLTEAGAPANAHAVMLGNAANLDR

SEQ ID NO: 16559 - protein, 61 aa, Myxococcus xanthus
FQFAQVSLYIPEEIIYLPLSVGGTVVMWNAIEYTRVKNPNVEDAIITVMSVFRSIIHEIFR

SEQ ID NO: 16560 - protein, 89 aa, Myxococcus xanthus
DGASSRGFLAPAKEDVVILRGDLLHVDFGITYMGLNSDWQKMAYVLNEGETDAPEGLKRALANTIELQDALMLRASRPGRTSAQVYTVE

SEQ ID NO: 16561 - protein, 44 aa, Myxococcus xanthus
MSIVANKQQGASGLPLCTTEFEHRMARALNDTTVLCLAQRVWGL

SEQ ID NO: 16562 - protein, 22 aa, Myxococcus xanthus
MEFPARVSRAESSGEATLGVLV

SEQ ID NO: 16563 - protein, 149 aa, Myxococcus xanthus
ALRVRTRAGVEREMRLEALRPTPKEDIVVLEGVESRNDAEALVGAKVFVFREDLEPPAEGEFFQGDLVGLDAVDANGNALGRVEEIWTTGEVPNLVIRASGREELVVPFADEFVPTVDLEARRIVIHPPEYVEAGRKGAESGGGPEDAE

SEQ ID NO: 16564 - protein, 57 aa, Myxococcus xanthus
SPPYPVEILTLFPGMVTGYLGASILGKAQEKGLLATTITDIREYAEGKHRVTDDAPY

SEQ ID NO: 16565 - protein, 71 aa, Myxococcus xanthus
LTDVDGERSVAQMLTDFAQDPDHLLRLAIMLKELDSVSFAAQDRLAQYEGPRAPGAGGAQPSSGAAHASAL

SEQ ID NO: 16566 - protein, 94 aa, Myxococcus xanthus
MGGRGTFLATAGGSLIGWGGALVGSALLGIGDNEPGGAVFLLLLPVVGAVAGYELSSPGEEHPTLTRKAPSTFQVVPVAGMGERGPRLGLAGSF

SEQ ID NO: 16567 - protein, 248 aa, Myxococcus xanthus
MSEDAFFTVYGNLPRHGPGSDDCTREALRRLPPLPPHPRVVDLGCGAGAQTLVLAEALRTRVIAVDLHEPFLDQLKARARERGLDALIDVQRQDMGALSLPEASFDLLWSEGAIYHLGFGPGLRRWRPLLAPGGLAAVTECTWLTDERPDEIARFWGEVYPTMGTVLENRAAAETAGYEVLDTFTLPASAWWDTYYTPLLQRVAHLRAHGDASLEDALSAAEQETRLYRQYEHTYGYVFHLLRNPSAL

SEQ ID NO: 16568 - protein, 39 aa, Myxococcus xanthus
HATDDTHTLMVLNCRVRELEWVTTSHQPAVKQLAREADV

SEQ ID NO: 16569 - protein, 36 aa, Myxococcus xanthus
MAYNPSLLALVEGVLFTLRDDQHMGYNLGQYTCYAV

SEQ ID NO: 16570 - protein, 85 aa, Myxococcus xanthus
CSQEALLRVRRIRGQTEALERALESGAECGTVLQQLAAIRGAINGLMSEVLESHIREEFGPASDEDPRHAQRVRDMTTLVRTYLK

SEQ ID NO: 16571 - protein, 71 aa, Myxococcus xanthus
KSRAAVAFEAGKPLSIVELDVAPPQKGEVLVRITHTGVCHTDAFTLSGDDPEGLFPVVLGHKGAGVVEAVG

SEQ ID NO: 16572 - protein, 193 aa, Myxococcus xanthus
KLMEFAALMLLVMLSLLGPSGRTLSRFEGELKVPVLLCVGLVALVVFLAHWSGPLAFALHRRHKLPRVEGFLHHVSEGLGTARSFTGMAKVFVFSVAPVLASALAYGLALHGIGISGGLFAGAVVLGAISLGQSLPGVPAGMGIYYFVTSWAARSLGASPEDAAAFATLTHLGTVISQVAVGAVSVHLRKNRI

SEQ ID NO: 16573 - protein, 51 aa, Myxococcus xanthus
CALKDMDVFYDVRKMLTPMVCASSWVNAGNWFIHLYMDVTDDFENVSLKDI

SEQ ID NO: 16574 - protein, 50 aa, Myxococcus xanthus
QYTEAVMVATTAHGRGRLLEVHIVVFVDVTGLDTRPLVMTGAGANPLLTW

SEQ ID NO: 16575 - protein, 46 aa, Myxococcus xanthus
MFESQLPHTVSYQASALLLAMGMVGPARLQDMQERKPLCSAVNALV

SEQ ID NO: 16576 - protein, 38 aa, Myxococcus xanthus
PQVHIWFAILLSLMVEAVFNSLPGSLAVCGTIFFGVGH

SEQ ID NO: 16577 - protein, 99 aa, Myxococcus xanthus
LLCLDCTKVEADTTYWPHFTDELRKGAFPAKLIEVALFHNVPLLAYVLDTLAFPIPTLVGFVGFGFLGTREHGRILTHEGSDFGQTLVLVIIYDLYVNH

SEQ ID NO: 16578 - protein, 758 aa, Myxococcus xanthus
MSTEQWAHRFFELSTEPYVILGRDGVLLEANPAFGHLVGLSLTSLRGMALQDFIPIEDAAVLFAHLGSTSPTSRTCRWRRPDGSWLPLSWRITAASESEPLYCTVQRAEEPSAAPWPESDYLPFGLYLVDIRTRRVHYVNHRFCQLWGITELEGAIQRGELSHDEVIHHCLKAGDAAEFLRLCAAPDQGCVPGLVEDEARLSDGRTLRRLSTSSSVAGDAMRYRMFAFEDVTESKRTQEALRRSEESFRRLIDRAPEGIFVHTQRRFIYANPTLLRALGYDDPAELMAKPIWSIVHPDDLELVKDRVHTAAVKGALAPLREVRYLRRDGTWYDAESVGIPIEFDGHEAVVVMARDITERKQAQSQLLQNDRMVLAGTLAAGVGHEINNPLTYVMANLASALESVSRLGAELTRAGERGPSSVAWPATLHDAEALLKEAQEGAMRVRNIVRDLKFISRQDEERREAVDVRQPLDFSINMAASQLRHRARLIKKYESVPRVYADGSRLGQVFLNLLVNSAQAIPEGNAEEHHITVWVRAGPPGSVLVDVSDSGCGMTPAVLSRVFDPFFTTKPVGKGTGLGLSICHSLIRKQGGDITVRSELGQGTTFTVTLPTAPDAVPTQAAPVAPAPHAERRGQVLVIDDEPAVGRSLARIIGMRHRVTVVNNGEDALAVLTSGAPFDAVFCDLMMPGISGMDVYERVRERGDGIAERFIFITGGSYTTRARQFLERVPNLQIEKPFDVESIHQGLGQLLGASRGSE

SEQ ID NO: 16579 - protein, 56 aa, Myxococcus xanthus
MMNDTLLCFIYHMISSTRDYNVFILLYETRMDDTLHTIKVHVYRGECNNDTLLLSI

SEQ ID NO: 16580 - protein, 168 aa, Myxococcus xanthus
MFANHSALLAEQLRDALSTKMYGRGPHRVLRIDEPEGPSTAGGKLARQAISLVPRKGAGTSLTCGWVDVSKREAQLRNFEAVAKRYALHHGEPLEMQAEEYERFLTDVEAVLTQAVIKVRVIVPEEAGAVRVASPSASAKGVPPVWAGLLAVLAFVLGLLAGRMGSGG

SEQ ID NO: 16581 - protein, 201 aa, Myxococcus xanthus
MDDPTIAFPLFERAQKLGIKNIAVHKGLPMGAVPLEPYKVDDIGGAADAFPDLNFEIVHGGMAFLDETGMQLSLFPNVYVNLEVTGALIVKRERWFAESLAALLKWAGPEKIMWGSGTVFSHPHPALHKFWHEFQLPDDLVQVAGMQVTPDVKRMILGGNYARYAGVDVESVKKKIANDTFAKLRARGDIQPYGYRESLYE

SEQ ID NO: 16582 - protein, 122 aa, Myxococcus xanthus
MSEQALRERIQDIPDPCSCATGVPLGIGEMGLIESVKRTEGQVTVRLHITSPMCMMAAYFMREIEQRLLTVDGVTAVNVEFDHDLKWTPQDIEPEARQRLAARRITMLGGRLLPQDSAQRRS

SEQ ID NO: 16583 - protein, 322 aa, Myxococcus xanthus
MTVAADYGRFAGLRSRGPAAAAKHGAVGALVRSLATASLRTPHTGATNFPSEGPRIPAASVATEDADLLHRLLAGGPVRVKLMLGSSELPDADSSNVVAEIRGREKPQEIVLIGAHLDSWDVGTGAHDDGAGVVMVMEAARLIAKLPQAPRRTVRVVLFMNEENGLRGGRAYAEAHAAELPRHVGALEMDAGGGRPVSVSVRAGEGGQDLLRPWLPPLTALGVTQFSAREAGGADISPLMPARVPFFGVEVDSSRYFDVHHTEADTLDKVDPQDLARSTAAVAWMTYALAEMPGTLTRPEAPAPRGPAPVTVPAQQSKTSGN

SEQ ID NO: 16584 - protein, 498 aa, Myxococcus xanthus
  unsure (1)..(498): unsure at all Xaa locations
SWGAGGVLAHDMGLGKTVQALTVLLDRSKLGPALVLAPTSVAFNWMDEAKRFAPSLRMTLFSDAADRGRTLEQLGPKDVLVLSYGLLTRDIERLSKLRFSTIIFDEAQTLKNATTHRFRAARALQGDFKFALSGTPLENHLGELWSLFAVVFSGLLGSWEAFRSRFAAPIERGVDPTAAPALARVLQPFLLRRTKAQVEAQLPPRTDIRVPIVLSSEEWALYEDARLAALSDLETRKPKMKEQERRIEILAALTRLRLLASHPRLYDAGSKLESAKLERFMELVRELRAEGHRALVFSQFTSHLALVREVLDAEGIDYEYLDGQTPAGARAERVRAFQEGDVPLFLISLKAGGFGLNLTAATTVIHLDPWWNPAVEDQASDRAHRIGQERPVTVYRLVTRGTIEEQMLSLHEHKRALVAGVLXGKDSAWTVVDTGVAGTVVPAAGSAWGRGGASDSALIRTVVLGPGCCCQNPSTHRGANLGDVWTTLPGRLLLGAKA

SEQ ID NO: 16585 - protein, 461 aa, Myxococcus xanthus
MPVTAKDLFAWHAREGAFERLTPPWERMEVLERTGDGIRTGARVVVRMRVGPIPQRLVAEHTAYIEDAMFQDTQMSGPFAKWVHTHRMWPEPTTGTSILEDEVEYVLPVGTLGSLFGGGFARRTLERMFAYRHRVTLEDLKRHAAFAGQGPLTIAVTGASGLVGSSLVPFLTTGGHTVKRMVRGKADPARNEVAWSPDTGEVDTDALEGVDVVVHLAGVNVAGQRWTPEYKDAILKSRTQGTRTLAEALARMKRKPKVLVSAGGSSIYGDRGDEVLAEESSTDGKGFLSQVSREWEAAAAPAEAAGIRVVHLRIGPVLDAREGALAKMLPAFLAGGGGPIGSGQQWMSWVSLEDLLGLIHFSVFTDAARGAINAVAPGAVRQADFARTLGKVLRRPAVFPVPSPVVRTLFGQMGQEALLDGARIAPQAAQRLGFAFLLPDLESALRFTLGRTTKGPEYHHS

SEQ ID NO: 16586 - protein, 309 aa, Myxococcus xanthus
MIQVEGLTKYYGEHAAIRELAFTISQGEVIGFLGLNGAGKSTTLKVLGCVLMPTSGRVVIDGHDVVSNAHEVRQRIGYLPDVPPLYDEMTVGEYLTYVAQLRGVTSRDTASRVGEAEEKTGLRDVHGELISTLSHGYRQRVGVAQALVHKPALLILDEPTSGLDPRQIVEMRDVIRGLKGAHTVLVSSHILPEISQTCDRLLIIHKGMLVAQGTEEELAAKMGGRGTIELEVRGDKARAVEVLQRFGSVEVDRASDGLVALTVRASPDQRPQVAQAVVGAGLELLRLDQGAGQLESIFLRLTHGQEARA

SEQ ID NO: 16587 - protein, 170 aa, Myxococcus xanthus
MRLLAEERQTGTLSLLYSSPLRDRDIVLGKFLAGLAFLALYLLCTVYMPLLVMVNGKVSFGHVAAGYFGLLLLGSASLAVGTFGSALARNQLLAAITSAVMLVALILCWLLARITEQPLADVFSAMSLWNQHFPPFQAGLIHVRDVVYYLVVTYVALFAATRVLEARRWR

SEQ ID NO: 16588 - protein, 494 aa, Myxococcus xanthus
MVEVAAAAMTRAPVLETGRVRSALYSGLGLAFVLVFAFASMFVATQADVTWDLSYFRTAKPGDGTRKVIRGLNEPLQVTLFFPPANEVGEAVGQYFRDLSVESPGLLNVVRLDQAVEPARARSLGVHNNGTIVLARGDRKEPLTVGLEVERARGQLQRLDQEVQRRLLTVARPRRVVYFTSGHGERAESRAVPGETTRPSVEKLKELLRAQNVDVRPLGVSEGLGTEVPRDASVVVVAGPTQEFLPEELNALREYSARGGRLWLALEPEGPDFQPLLEPLGLKYLKTPLANDQVYFRTSRQQSDRGNLGTATFSSHPSVTSLSSLAGQAPAVFLSAGALEQIQPLPGGMAQDVSVRAHGATFADANGNFTLDAGEMRRPWPLVIAVEKPAPAGQAAMRAVVMADADAVSDLLMGNMGNAYLAVDTLRWLTGEESISGAVSSEEDTPIQHTREQDVLWFYATVFLGPALVLAVGFVTTRRRGRRAPRPAVAGGER

SEQ ID NO: 16589 - protein, 371 aa, Myxococcus xanthus
MKVRDLALQGALAAAALIAAFVVWQREPSAGPGEVTVVDVPARALDSIRYEDDSRFVDVFRDASERDRLWVRLGYKASRAASGGANAGATDAGVAPQAADAGGATAAVGTDAGTGAAAGQPPVAAREEPPPPRELRANEVADKLFSRFAPMRAMRALGELDAKKQEEVGLATSPRKLTLTVAGKARVFALASPPGGWGTPYLRSEEDGRVYLLGPAMLPDLENANSRLVDRRLHTFDLGDFDAVTIRAGGATRAFQATGKAPGPDVLAPEDAPERPDDFTRNWHDPVWRMMPVDLLGRDEPLPGGEPQESFRVDYLRAGRAVGHVMVVKGEGGFYARTEHTTGWARLHSGMDALAEEAVRVTAPVSTASGK

SEQ ID NO: 16590 - protein, 390 aa, Myxococcus xanthus
MRTTTRAPVRMPSPVRSSTSIRSQGGVRRSNAPSRACQAKRSLAVTGIRVRASKTCDLPMFPPGATVRRRMIAPESLERAAELLRHGGVVALPTETVYGLSANAEDELAVRRVFAIKGRPATHPLIVHIPGVEHLNTWAREVPEAARKLAEAFWPGPLTLVLPRTARATDAVTGGQDTVALRVPNHPVALAVLQKLGGGLAAPSANRFGKVSPTTAEHVREDLGGDVDLVLDGGPCTVGVESTIVDLSSNEPAILRPGGLAAEDVERVLGRKVPVRTSSKVRVSGSLESHYAPRAGVVLTEPVQAVARVQELRGQGLRVGVLGPASLALPPDVPRFDVPDEPAGAARVLYARLREADTQGHDVLVACLPAESGLGIAVRDRLSRAAAPRG

SEQ ID NO: 16591 - protein, 268 aa, Myxococcus xanthus
MSANGTAYGIDVLAFGPHPDDVELFCGGLLASMAARGYRTGIVDLTRGEKSSRGTLQSRAEETEAATRALGLAHRENLELPDGWLNPWAGFDTPEPERARTAAVARVVEALRRLRPELVVVPWEQERHPDHEAASALVTRALFFAGVRKFDAEPAAEPFTPRQVLYYPMRHLTEPSVIVDVSAVYERKLAAVHCYASQVLPRPDAPPTLVGSPLSVSSLEARDRFHGAQIGVTHGEPYILREALGLADPLDHFRRNSFAKPLFFPSRT

SEQ ID NO: 16592 - protein, 69 aa, Myxococcus xanthus
MREHPPVGERMLLNAAFLVERPRLEPFEEKVRSLAARSDTYTFRFTGPWAPYSFVDVHLGLRDEDASLP

SEQ ID NO: 16593 - protein, 56 aa, Myxococcus xanthus
LLRLGTTLQVPMKLNLEGVEDAILPAAPGLEDFTQPPPAPGLEDFSAPPAPPAPAP

SEQ ID NO: 16594 - protein, 246 aa, Myxococcus xanthus
MRADFGIAVEAPSHRGKRLHRLRFLETELHLGVPSLDLTAARYDFSVERDDPLFRVTTFFGKPRRHDLHLNLGLWMETLRVEELERGGEVGRFLTWGTLHATVDLWHSKDLVSYVRVRAGPSFERDYANGFNTFVPGAALEADLTLDQDGFHHLRLGVEAEKVLLAPAVVGRPLRPERLRLQAGYEVIILAINDQPLSLLVDGRGMKRGDIAGVPEQWEWSASAGLRFSLWAPARRSAPMATSVKE

SEQ ID NO: 16595 - protein, 292 aa, Myxococcus xanthus
MLMLGLALLLATAADMPRGVPDDDACVALDERGERYPICFDPGDGFVVGMHTRLSGSAMAQAVRTGVHIRSGRSSRSKGSPWFNNHRLLGLEAWDGEQRGLTFTAYDGTLRRHLEEGFILVPTARPARIPFPFDVTVALRLGHLERRVWEGPGWTLETGRLGLLLDPMRAETERVWFGVGPVAGHAVRRSREGVSHTVAPFTELMFDAGVESRDGLWALRASGLAGWSIGIERGLHFRARTDVGLERVVLAVADQPVVLQVSGAYVHRDAGLDRRSEWTANVGLAVRVFGAR

SEQ ID NO: 16596 - protein, 269 aa, Myxococcus xanthus
MNQQGTQPTAPPVIAHTPTPPLDEDPPPAIEEQAAANDTPPTTAAAAAQTPETPPPPRGPSMEEQRAVADKAIAARDFDTAVDALERIKDANGQRPRDVETRLDEARAEQLMKRRLDDVRNALGDGKLPEAEEALRESAATKAFAKEYAALKTQVAEARKKAAPPAAVPSSGTEKAPPAAQSAAAKAQADGFEHIKGLRYRQAIEQLNKCLELEPTRAECHLYLGSAYANDNQPEKGAVHYKRFLELAPNHAYYERVKGLVESYENPKK

SEQ ID NO: 16597 - protein, 144 aa, Myxococcus xanthus
MMMPQMSGTEVLEQIRKYDTDVAVIVATAYPTVDTAVASLKAQASDYVKKPMEPEQFITAVRNALQKKGLSQDPEADLHRAIGRTIRDARKTQELTLKQLARRTGLSVSLLSQIERAESSASISSLYKIASALQLRMGELFGDT

SEQ ID NO: 16598 - protein, 680 aa, Myxococcus xanthus
MACAVHERVWDVSQEMRIPAGRTSPCQPCAGRSFPGRQALMPLRFKSRSALLWLTISLSACREDVPPAPVVPPIEDPREEQSVPYVSIDGMDNASGFLRGTIQGQGDIRAVEVHVDGVLLGWAEVNGDQWSIQWLPGAAMHSIEVVAHDGSGTPARASLALQPLDFATPHALYQPPSLLTLPTSESATTRYTLDGSTPTAHSPIYTSPLVLMRSQGEPTPLSLIPTNPPETPVEWRWLPPRGPVSRAAVVRFQQFQDATPVGASGTRSYLIDKSHGPLPVMSLTVDAEHFFGFEHGIYVPGRIHAEDPMPDVMWGNGNYHQSGKDWERPLHVEWFEVEGQPVISQGAGVRIHGSGSAALPHKSLRLYAKEDYGPKTFRAAVFPGEALDEYTRLIVRTSGQDLLYSKIRDCALQGLLRETALHLQACRPTVLYLNGEYWGLHELRERYDEYYLASRHGIDRKKVAILELDGMLDTGEEGDESHYLALLDFVRNNDLSLPENLAHVESMMDVDDFIDYQIAEIFFANTDWPHNNVKFWRYVQPESGGAAAKDGRWRWLVYDLDNAFLGDPGYDSLARVMTDEALPEWSVLLIRQLMTNADFKNRFVSRFQWHLDNTFSEERVTAQLESLADLIAAEIPAHIERWGYPESVESWRYYVDAMRDFATQRPTYVRQHLEVSFGPF

SEQ ID NO: 16599 - protein, 225 aa, Myxococcus xanthus
MVYGDFSIRVTDPERLVVGLVGMGRTGNDELLGWFKNQVLKVTRDRIAELLVKKRWPLLDVTSGAYTEEIETEVISGLKPHVDGYGLTVVRMGNFHVSIKEEDEATLKKLGKDVAYSRLAGGFQQYAQGQAMLGAAEGMAKGGGGGGGAGNALGGMGMGMGFGMAQQFMNQQQHQQRPPEPAPAAPPADTRSPAQRLKEIKELKDAGVLSDEEYNAKRAELMKLL

SEQ ID NO: 16600 - protein, 458 aa, Myxococcus xanthus
MGLFLGPLYTLYKAASAIVTARALQEETGRPCVPVFWLQTEDHDLPEIDHCVIPRPGGGPCRLALELPDAATSRAPIAHRHLGPSVLPALATLRAELEAEPHAEEFLSLLERAYRPEATLAGAFTDVLSSLFADEGLVFLDPRDARLAPLAAPVHRFALQEAGALSSVLAARAEALTRAGYTVQVHVRPGSPLSFFSPDALDGPRYRLDPAEADAWSLVGHPESSAITQDALHAALEREPLRFTTSALLRPLLQDTWLPTAAYVGGPGELAYFAQLAPLYAHAGRPMPLAIPRARFRVLDDRARRWLGKVGLQPDEVNVPRDALLTRLATRDAPESLETPEALEARLFGAFASELERVAGQVSAVDANLQDALRRTQGTVRVAVSRLTGRYRRALARRDATAAEQVDRLRTFLFPEDAPQERILGLPYFACRIGTRAFTKRVLDACVPFSGDSKDLTP

SEQ ID NO: 16601 - protein, 111 aa, Myxococcus xanthus
MGIFDSIKGEAKRNFIARADSAKGDIIYKYPENNVRMLTQLTVDADEVALFVKDGKVEGKLGPGRPLAGHEQHPVPVPPHRRLHGWQPLHLRNLLRLHPGVRRREVRRPHR

SEQ ID NO: 16602 - protein, 266 aa, Myxococcus xanthus
MAFRPKRALAVFWKDFLDLRKNVGLLVSMMVLPAVMVLVPIGVVWTYVRTPDHADLRSVALFYDPTLPLGASAARFLIDKTLTDWFGMFLVMPVFVPILIASQSVAGEKERRTLEPLLASPVTAAELVTGKSLAALVPSVAITWTAFVLFCVGVDIVAWPLVKMPLMPNALWTFGVFVIAPLFAFFGNGVAVLISARVSEARMAQQLSALVVLPIVGMVGGQVAGVLKAGFGYYLLQGAVVLVLDALLLWASIRLLDRERLVSRWG

SEQ ID NO: 16603 - protein, 258 aa, Myxococcus xanthus
MLTGLLQPTEGEATVWGHRVDRDGEPLRKVVGLLTEQPGLYDRLTARENLRFFMKLHELDEAAAWPRARHYLERFGLGGREEEPVGGFSKGMRQKLAIVRTLVHDPKVIFLDEPTSGLDPESARTVRDAVAELASEGRTIVLCSHNLAEVERLCERVAVVKRRLLAMGPVRELRHAGQALEVRVEGEAERFCLALAQLPFAPNVLAEGPKLRVMLADDAQAPDVVACLVGAGARVHSAVPTQRPLEEVYLELLREGRG

SEQ ID NO: 16604 - protein, 668 aa, Myxococcus xanthus
MWMQALGMNVVGAANPGGMLGLYTEWGMRMPFALLSITAVALLSLAVARVVSRRAGLATGFVLATMPLYFLLTRQTVTDTPFVTTFICAMACALIGQLDATTKHRAAWWYGFYFFAGLSALAKGLLGVGLPAVILVLYAALSVIPWDSDSLDAHLKWLTQSRFRKDVREGRQPMPVLWGQMFKMHLGTGILVFFAVAGPWYLTLSLFGSVDDEGKLFWYRFFVHDHLNRLTAGVHTTTPGGTFIYFIEQGGFAIFPWVALLPGAFSVVARLKLRSEKAADHLAIIAVLWVAFSFWLLSSSATKFHHYVFPVLPGVAVLLALFIDRLWEEGISAHAVSLIFGFLLFVLVGKNIAENPKIFTDLFVYNYDRTYTQDLVTKPIAFFTSRSLWTGDLVTLVLLAFGVYLSFDAFSAKGRARTTPSARAVALMLLLGGVATLGAVSAQAQVSAKALVGVAVLAVAGYLAWESMRPGAEGRASLQTLAGVLAVVGIAFAVRGFRQPAAEDSLLKALSEPVNIKKTLGFTFAVAGGMAVVASLMRARAMLFGTFWVLAAGMALWFNWSHWVDLSHHWTQRDLFWRYYAQRQAGEPIVAYMMNWRGETFYSQNTVEQYRVSDANARMRALAQRPGREWALVEHNRLNLLRTAVGSDKVVTPVDRDINNKFVLVTID

SEQ ID NO: 16605 - protein, 122 aa, Myxococcus xanthus
MSQVGSMSGTANNAINVADTFESGVRVIKDGLQGNMPSSMPSTTVAKTVGKAVPFLNVFSTLSSLSNTRDVFTNPTSTPSQKAHAVIDSATSVLSAVPYPPVALGATLVNVLNGAVTPTEPK

SEQ ID NO: 16606 - protein, 252 aa, Myxococcus xanthus
  unsure (1)..(252): unsure at all Xaa locations
MGWTSVGVDNAGHLGGLLAGLLAGVFLEPRWHPDTGWLRPVGMVVAAVVXTGGVVAERSVWRMERDDGFGLSVALPRDWRGDVDGQGRRAFSNGLPGRGRATFSAEAIEAGEPGDGSVQARQFQQEVLVQGAPSPEGRTLKVTEPVAARVGGRSAQRLHAELEGPGGPTHLMALFVPRGEWVYRLVFTWPAAYPAYREVVDRMVAEVRFDEPSVLREAGATPLIAPTTPPPWRSWPTALSRTKGPPRKQWRR

SEQ ID NO: 16607 - protein, 84 aa, Myxococcus xanthus
LSRLDDCLADAETRALALCATLAGHAPLAVSGMKESFGRLARAPLEEADRARLRGLRAAAFGSEDAKEGRAAFLEKRPPRFSGR

SEQ ID NO: 16608 - protein, 90 aa, Myxococcus xanthus
MAVEPEVLLMDEPASALDPIATAKIEELIHELKSTYTIAIVTHNMQQAARVSDRTAFFYMGELVECGPTEQIFTNPREKRTEDYVTGKFG

SEQ ID NO: 16609 - protein, 225 aa, Myxococcus xanthus
MHTDKAFEADLRDLREKLLAMGAKVETLIVQSMKALTDRDSALAEKVVAADKDVNRLEVDIDELCRKILALRQPAASDLRLITTALKIVTDLERIGDLAVNIAERSMDLNQAPPLAPYVDTPRLAELAQRQVRMSLDAFVSGDVAKAEEVLRGDDLLDALFLKIFNELLAYMMEDSRNIRRATALMFIAKHLERIGDHALNVAEMVVYMVRGKDIRHPQSRNLAE

SEQ ID NO: 16610 - protein, 402 aa, Myxococcus xanthus
MLLASTVLLLAACLGLFVLTVQFALVLRHRREPSPTAQPGTPRPGISILKPLCGVDDDLEANLAQFAALDYAGAYEVVLGVKDARDPAFAVARAAVARWPHVMRLEVQDGEPGRNPKVNQLITLADRARYDVLVISDSNTRVAPGYLEEIAQAFEDPAVGCVTHPVAGMGERSFGSLLDNLHLGASAAAGMIAAKRLAGQDIVVGKSMALRREDVDALGGFFSVKDVLAEDYVIGQWVTRKLGRRVVMAHTPVFNVSLRKSVLSFFQRYVRWSVIHRTAVSPGTYLAQALLNPTPLALLGAMLAPSSDTAALCLVVALGKVAVDLSTVRALRPQALSWDAVPAVFAKDALLFAAWSYALFSRTVNWRGTRLRVGRGTRLMPVRTAGLTSEPALPQGDRILAG

SEQ ID NO: 16611 - protein, 716 aa, Myxococcus xanthus
MKLRKPSAKTRPTTLKSESLEPHRMHAVGKVLTTDQGIPISDTDNSLKAGIRGPTLLEDFHFREKMMRFDHERIPERAVHARGAGAHGYFQVYKSLEKYTQARFLTDPSLRTPVFVRFSTVGGSRGSADTVRDVRGFATKFYTEEGNFDLVGNNMPVFFIQDGIKFPDFVHAVKPEPHNEIPQASSAHDSLWDFVSLVPETTHMIMWLMSDRAIPRSFRMMEGFGVHTFRLVNAAGKANLVKFHWKPLLGNHSLVWDEAQKLSGKDPDFHRRDLWESIERGDFPEYELGLQIIPEGDELKYGFDLLDATKLLPEELAPVQRVGKLTLNRNPDNFFAETEQVAFCVANVVPGIDFTNDPLMQARLFSYLDTQLTRLGGPNFAELPINKPVCPVTNHQQDGFGRQTIPTSRANYHPNSLGGGCPVLANPASAFRHTQERVEGHKIRARSGSFSDHFSQATLFYKSLSRPEQEHLVAALEFEVGKVERVEIRERVVNQILVNVDPELAVRVARAVGVTPPKATRPPKPSKAAGKKAAPSVEVSPALSMENSPHDSIRTRKIAALVSDGFAGKELDGVRKVLEERGATLELVGPTLSPVTSQEGREERPLRTFSTASSVMYDAVYVPGGEKSVAALLRVPLAVDFVREAYVHCKALALSADANTLLDAAGVRDLEAPPSKGLDATRGVVRSAKVETKGFGQLFTESIARRHWEREAPPPA

SEQ ID NO: 16612 - protein, 228 aa, Myxococcus xanthus
MGDVTVGELSVARDEMVALRRHSSPEEIRRVLLEGGHSRMPVYEGTLDNIVGYVIAKDLLGVAWEGNLIILEDVMRPPFFVVETMRAMDALKELQKRRMQLAVVVDERGGVVGLVTVEDLVEELVGDILSESEVPEEYVKREGPNTALVLGTANIRDVNRELSLDLDEDQDYATVAGLCIALSGGAIPEPGTKVQTEGGLVLEVVASSPRRVDTVRFHLPQREEPVEA

SEQ ID NO: 16613 - protein, 406 aa, Myxococcus xanthus
MNGRIRLVAALCWGVMMGLGCGGFDERPPSQEPQATVPQAPSLVIAVPGDGQVTVTWDVPSDGGSALLDYAVHVHSDAAEVRVVTAPASESRAVITDLTNGTAYAFSVVARNARGNSAASGRSDRVVPHVTPGAVRNLVAVESDQRVTLSWDAADDKGMPLDSYFITPYFGAQEGEMVRVPATELGKTFHPLTNGMAVRFVVVASNGHSRGPEASIEATPYTTPGVPVVTVFPSGQRVRLAWSVEDTGGSPITSYRVTVYLGDEVIRTVDTAATGTLVEELENATTYHFTVEAENAAGWGGVSERIAAMPTRAPSMPLNAMCQGGDGWISFSWEPPEFDYGNPVTEYRINAVVNGNSTDWYTTDLSYHLTDIPNDGRVLYFFISARSAVGFGSSADLTCFTQPARP

SEQ ID NO: 16614 - protein, 1043 aa, Myxococcus xanthus
MGSLSNALQAGFDFNSPDADVVGFECILASPSTAPMPDEEDARWAGCAASYLTPELTHNTTYRLWVRAVDAAGNVDGMPASHEWRVDLEPPDTELTAPLPAPVNNQTSVPFTFSSNDPQATFECSLNGAPFATCTSGIIVQTPGADAPFRFLVRARDTAGNVDPTPAAYSWRTDKVRPDTVLHTTMGSLSNALQAGFDFNSPDADVVGFECILASPSTAPMPDEEDARWAGCAASYLTPELTHNTTYRLWVRAVDAAGNVDGMPASHEWRVDLEPPDTELTAPLPAPVNNQTSVPFTFSSNDPQATFECSLNGAPFATCTSGIIVQTPGADAPFRFLVRARDTAGNVDPTPAAYSWRTDKVRPDTQVVALVDSPSNALRARFNLSSPDTDVVGFQCILVRPSSTTMPEEDDEDWEACGASHLTSELITSTYTLWARAVDAAGNVDATPAGATWTVDRDPPDTVITSKPDALTGEPTTAFAFRGGDNDTDVVGFECSYDGRDFLPCESPFALPNPPGIPVYAEGDHSMLIRAVDAAGNRDETPANHIWRLVVGDPVTYFQTAPPTVTRQTSASFSFTSNLTTVIYACQLDDEPREEDCATSESPTKPYTGLAEGGHTLRVWARGGGREASSPSVYNWTVDLTGPVAPVINVPAQNDVYFNVQWPQFSGRVSERGTFIIKMDGDIVGTFQVSEQSLSWSFESPVQLADGPHVLAVSLTDAVGNDGAEAFRTFTVDATKPETRLTAAPPHLTNQPRAVFQFESNEVGTTFECSLDGGAFASCTGPNSHEVTVGDALHTFAVRAVDRAGNVADVQGAHEWRVDSVAPTTNIIEMPVADTNVARAVFRFESDESFVNFECSIDGAAFDNCPPAYTWDGVPEGEHRIEVRARDEAGNVDATPAVHVWRLDTTPPLVPVVSSPAPEAVVGSLTPTFQGSAEPGSEVLLFVDGLDFGSARVEPTGQWRLTLTRAISEGDHRFSALARDAAGNESERSAESAFKVDPSINIIRAVSSRGGGLSCAAGGRGSAPLLLLGWGVLVLMAARRRRV

SEQ ID NO: 16615 - protein, 597 aa, Myxococcus xanthus
FLSAGAQEAPVLQGFNLKRLKLNPGAEGSLLVGMGELLPVGAFRATVMMHYAHQPLVYMDNLIREQPEVAIVSGRTTAHLAAAYAPLDWLQVGLQVPMVAFQGGDDVGMARYGIAVPASQALSTPVVSARFGLLRQTEAGGVDLALDVAAGLPLGSEGAFARDDSGLRLSPRVMVGRHFGFIRAGLEVGYLQRPRVLLTDRTGETEDEVGQELRLGVALATTGKRLRWELNVRGMLPLTDQPTSVELLPGARYLVGSSLEMFALAGVGVGAAPGTPLFRLMVGGAFGNVTPPRGPGESSVRCEMGLPPEAKIQECPDMDEDGDGVRNADDKCPLVPGDVARQGCSAQDTDGDGIEDMLDGCPLEHGPAARQGCPIPDQDGDEVPDEIDSCPSDPGPADNRGCPVRDTDGDGIDNDKDECPNEAGPIERNGCPESDTDKDGVPNRADSCVNEPGDAKNLGCPLHILPLVEIRPDRLVVMGKVFFEPTQARIQKRSYELLDWVARVIREHPEIPLVVVGAHTDDRGFPDDNRRLSQGRAEAVRQYLIGRDIAPERLKALGYGQERPIDSNATSNGRENNRRVEFLLADPQQDKSERGQR

SEQ ID NO: 16616 - protein, 769 aa, Myxococcus xanthus
MRFVSRLWDVRTASLLREFESVDLCPKGALVECTDALYADISGEDTHAFGFSPGDGTLWLGGRRGTLFRWSHQGAVPSIPDAHQDRITAISFSDSGDRVLSASRDRTVKLWDANTGRTLRELTFQEPCTQAVLSGDSRYAWVGGEELTCLYDLTSDARLIRCITTHDPGPSVAFSPSSRLAVLGDRRGEVSLRLLELPSGQDLHRPLTKLEGHALMPSFEDECSLSAFDDTFSSALTVRFCDSGPGNATGSAASPRMRTRWRPIPLHGRLFENGRRAVDFAENPVGAHPFIRVPQATLRWMFRQGPLESRAERALVAPDGRTLLAQAEPGLTRKTIDISTWNEYVPGGFAVSKDLRWMVVREPQSGQLSLVDRESSSQTALGACDVEGVYPPLEGAFSHDGQFLAVRCGVNVRFWDVAQANRGPRTQPPPIEAGINLTSLPAHWRWRHVTPTEDHATESFLASPRTRAHLQRTEVPGDGACQTQRTFSQSALVEFAPSGRYFAIGDERSVYLGSARDCRLTREAPLAASAITSQGASFSPDGERFVTISNVPESSAIWESATGTKLAPLPTSLGAVVMAFSPDSKYFAVANHPDVYWMGQAYLLDATNGEKKPLAAIDGKVKALSFSPDTSRLVAVTDDAIHLFDPNSGALVRRIDVSTDIHVKVRHAQARFGVSDTSGKLHFWRTSDGRHVAELHQGYRSGLEMEPDEEGTRIATFDSDGAYVFSLRPDDLLRQACALMRGRREYAPVQSICDTFLLPAVPLADLQTP

SEQ ID NO: 16617 - protein, 232 aa, Myxococcus xanthus
MLEQHREHIERTIDATGRIELAGSGMLGTGFLVTDELVMTNRHVAQHFCRRATDKWVLRLGVVPRVDWLGEHQRDAQATFPIQGVAAVHAVHDLALLRLGAPKGAVLRPAPLRLATQAPDATDSRALYCVGYPMKDHSRTPPEVLLRIFEDAFGVKRLQPGELLSLDPARQQLSHDCSTLGGSSGSPIVELETHAVLGLHFGGTRQENHAVALWQLADDPLLSRAGVRFTTP

SEQ ID NO: 16618 - protein, 85 aa, Myxococcus xanthus
MPPTVAELKQWIARSGVSVRKWLNTSGQSYRALGKAKVDAASDAELVEWLAADGKLVKRPVLVTGDTVLVGFKPEAYEQHFASRG

SEQ ID NO: 16619 - protein, 156 aa, Myxococcus xanthus
MPRVEAHIASDAALARALADLYGIETPAEPPMPPSLAPGGPLLLYGWSPVTAVLITRLLARNGLQARTATPLEVLHTGPEDVVLAPLQAMEGLLAGEVHIKGALIVHGSDDESFDRVRELGARGFLASPRDEELLLRAVRRLRPHPGSPDSAPPSH

SEQ ID NO: 16620 - protein, 314 aa, Myxococcus xanthus
MSPRIGNRPQPPPPPPPPPPARDTRPPAQGGRNGPRVDTRASASGSVEQPRHSALSGQSSFTAGGARADVSGTGPGGIDTRAHVQGPTFSADAQVDADIGLSGIDVSVDIDIEANLIEAGAGASKTVEFEIAGEEYSVELDLEALGKIGAEGSIELDLHVGTDGNVSINASASGFAGAQASLTGSIELKHEDDTLASGSITASASAGVSGDAHANIGIENGNLEFDVGVEATAGLGLGVEIEGSVNPGNVLKAVGETAAAAGGEILENVVDGAINAGGAVADAAGQVFTNAADAVTDFAGDVGNGIKNAWEAVF

SEQ ID NO: 16621 - protein, 390 aa, Myxococcus xanthus
MAVSKLASSAARLMKQGLLKEAARDFERAIEQDPKDASALLGLARLRLAQHDETAARAVLQRLVALHPTHPEALSHLARLDAEKGDARQLDLLAALAAQPKAGFFEVINHGRALLGHDRYAAAIPELERALALQPGNAQTLTYLGMALQGDKQLDRALRRYLEAAEANKTEHLPLQLAARVQLLQGHVGAAIVTLRQAILRSPRETALFREFASLCLMAGAPEAAMRAAIELRLQLPDSADAIYLHGISAFVAGKDEDADRILREALAKAPESAPVRVALAKVRRKLGDDAEAQTLLEAAVATDPSEAGAANDLAVLHLSRPGGAAAARAILTEALKHHPDDAGVHLNLALALADSDKAQALTHARRAQASTHRDIREQAERLVTALSPR

SEQ ID NO: 16622 - protein, 125 aa, Myxococcus xanthus
MMAPPAPEKAKQREPGQGQPRKRRKSAVYDADGQEVLISLMCIKCKTLKPLAQFGLRKMADGAIRNQPWCRTCRSGAGSKKPKAGKDAAAVAPVEEAAPVLQVVPAAASPEAGESPAVPVAAAQG

SEQ ID NO: 16623 - protein, 219 aa, Myxococcus xanthus
MLKKILVGLAAVILLFVGFVVSRPDTFTYQRAAVLPVSADIAFALVNDFRRWTDWSPWDGLDPQQQRTYSGPESGTGAGYAWVGNDQVGEGRMTITESKANEQVTIKLEFIKPFAATNTSTFAFSAAEGGTQVVWAMSGENNFMSKAMSLLMDMEAMIGKDFEKGLATMKDVAVADAKKRAEAEAARVAEEKARAETEAAAAAAPAGEGAPAVAAPAVP

SEQ ID NO: 16624 - protein, 438 aa, Myxococcus xanthus
MKASRFPRSLFALPVVLVLAACSSGPDDRPAPGEDAGVLDGGADAGTPDSGTDAGSDGDAGTPDAGPDIEVPEDGGTIVRGTLTGRLTVEGSPYRVEGDSNGVVTIPHGQVLTVGPGVILDFRGRPEVSERDVDSDAPDNVMNHQAGRVEVRVYGAIQIRGTADAPVLLTSTNPHGWWGMNFYGANSVGSGDPVFEHTIFEKVRKNQYNSDRDWTRAALWVYYPGAVTITGSVFRDNESSANCGALDLMFTDGSRVEKTIFENNRIREIDRFAQPGTYSMAGGGAVCITHGRNTVLRGNTFRGNFVQAFGGSLTSDLWDRPILTWPNPQGIFDLGGGAAIHYFQPDNDLLEGNVFDGNFIPLGPGAAVQLEDIGGSRTVVMRGNRFVNNRGGAGGVITCNRGSNTGELVITRDNVFTGNTVNGQPATNMTGDCGVVTQ

SEQ ID NO: 16625 - protein, 37 aa, Myxococcus xanthus
MRLRMADGVHFTVAGGRYFANKVYPEVLSVLGLLQQG

SEQ ID NO: 16626 - protein, 99 aa, Myxococcus xanthus
MRSSTWHRALAIRGEAPPPELRRLPVSCVCIQGTRDVLVPPSTVERLAASLPPGTPRHLLRGAGHVPYFTHPEACAGLLRPWLAALDAAAAPEVESSAA

SEQ ID NO: 16627 - protein, 254 aa, Myxococcus xanthus
MIEVEKLSKRYEGRPVLEGINAVFSPGEVTALVGPSGGGKSTLLRCLNGLESFDGGLVRVGPDTLAPGDVRAQGEKVRRIRRRVGFVFQQWHLFAHRTALGNVTEAPMHVKGVGRQEANERGRALLAKVGLSHREDAYPSELSGGEQQRVAIARALAMEPEVLLMDEPTSALDPERVGALIDLLEQLLADGLTLVAVTHEMRFAYELASRVLVLHGGHIIEEGPPARVLANPHHERTRAFLGLGRVPALRTLGA

SEQ ID NO: 16628 - protein, 167 aa, Myxococcus xanthus
WAARLSTAYVELFRGTPVLLQLYVLYYGLAGVLRLDPISAAILGLGLNYAAYESEVYRAGVLAVPRGQLEAAMALGMPLRLALRRVILPQAFRVALPGVANDFIALLKDSSLVSVISVVELTKRMTITAVDVRSWLIPGALCALMYLAMSYPLSRLARHLEARLERG

SEQ ID NO: 16629 - protein, 39 aa, Myxococcus xanthus
AGLISLLAGVLRLGRIAQFFSASVLTGFVFGLALIIAIK

SEQ ID NO: 16630 - protein, 128 aa, Myxococcus xanthus
MTPPPVVLISDDEPLIVSALAREGKRSGLNCISDTTSERVLELAREHRPAVIILDINQHQDGRDLLAQLKQDPNTRDCKVIILSAVEDQFTRHVCFELGADDYEVKPFDPTFMTRVARLASSVARPRT

SEQ ID NO: 16631 - protein, 473 aa, Myxococcus xanthus
MSAERDLDLLLPLILFEATKVVEADRCSLFILDRERNELWSKVAQGSKSEIRLPVGSGVAGQVAQTGAVINIPDAYADARFNRSFDVSSGYQTKTILCVPMRDAGGEVTGVIQALNKLDGASFNAEDEELLLALGAQAAGAIENALLHEDINRLFEGFVSASVVAIESRDPTTAGHSGRVADLTVAMAQALEHLSTGPYAHTRFSAGEIQELRYASLLHDFGKVGVREPVLVKAEKLYPHELEGLRARFQLARKDLQLQSYRRRLEAVKIRGQANLAEIEAEEEERLARESWQLDEVLEFILSCNRPTVLAQGNFERLHELGALRFLDAHDKAQPLLLPGEIQSLSIARGTLSPEERREIESHVEHTYRFLSQIPWTRTLRRVPEIAYAHHEKLDGTGYPRAEKDIPVQSRMMSICDIYDALTASDRPYKKAVPHTLALDILRRESDAGQLDPALYTVFIEADIPRKVLQGIK

SEQ ID NO: 16632 - protein, 435 aa, Myxococcus xanthus
MSATEQTFPADFTFGVATAAYQVEGGIENDWAEWERAGKLKEPDARCGPAVDHWNRYEEDYALARAVGATAFRISLEWARIEPERGRFDEAALESYRERLLKMKAHGLRPVVTLHHFTHPTWFHRETPWHQPASVDVFRRYAKRCAALLEGLDALVISFNEPMVLLLGGYLQGAIPPGLADGPTTMRAMENLVRSHVAAREELLSRLGRVELGISQNMLAFAPDRWWHPLDRALVRLGAQAYNHAFHEALATGKLRVTMPGVASTRVDIPGARDSVEFIGVNYYTRAHLRFVPRPPFIEFKYRDIHGRGLTDIGWEDWPEGFLQTLRDVKRYGKPVWITENGIDDRVGVRRPHYLHSHLAQVLAARAQGVDVRGYLYWSLLDNFEWLEGWGPRFGLYHVNFDTLRRSPTPACDYFRAVATGRKLVAPDAVRPSGA

SEQ ID NO: 16633 - protein, 84 aa, Myxococcus xanthus
MVVYILSWMLIVFVSVLIHEMGHALASRLFGYRPSIALVWMGGHTLPTDAPGPLPWKRDLLITAAGPFFGLMLGVTSGVDYLLL

SEQ ID NO: 16634 - protein, 443 aa, Myxococcus xanthus
MFARKLADTGVLERLTRLKVELFGSLGATGKGHGSDKAVVLGLMGETPEAVDVEAVPAIISRWRAEGRVALLGQREVTFRDGEHLVMHRRRSLPFHPNGMRFTASGADGAELASTAYYSVGGGFIVDESAAAAGKDPLSKDTTPLPFPFHSAAELLAHCERERMSFSSLMLANEKTWRDEAEIRAGLLRVWDVMQACVRRGCTSGGILPGGLKVERRAAGMYQKLISRPEAGLTNPLTVLDWVNLYALAVNEENAAGGRVVTAPTNGAAGIIPAVLHYYWRFVPGANEDGVVRFLLTAGAIGVLYKENASISGAEVGCQGEVGSACSMAAGALTEVMGGTPLQVENAAEIAMEHNLGLTCDPIGGLVQVPCIERNAMASVKAINATRMALHGDGRHFVSLDKVIRTMRDTGRDMKDKYKETARGGLAANVLEVANLSVGLPEC

SEQ ID NO: 16635 - protein, 325 aa, Myxococcus xanthus
MIANFFWAFLNMLPVLPLDGGRITTTLATRVFGPRRGFVLAQGLALLVCVGAVVYGLRSGWLLLTLIFAMYGMQSFRVVAEALRNGQAQSVPLEGPLAEKLREARAALDAGRMDEARRLGASVLEANEGLTPRVASHAHHLMGWLALKEGQGRQALDHFSQVQGLPVEPHAVAASFSLVGDDARAVEWWKQAWQSSSDRTVMHEYAGTLIRMGRESEALKLPGLDPEAAFSCAERVLFIRGAYSEAAAVGEAALQHAPSATLAYDAACAHARARNVPDAMRLLRRATELGFADGAYAASDEDLAPLHGYPAFEEWLTELRQSAAS

SEQ ID NO: 16636 - protein, 326 aa, Myxococcus xanthus
MCLFVFAVGAKPVDVAVCVGLYVVRMWGITAGFHRYFSHRAFKTGRVFQFILAFVGSMSAQKGVLWWAEHHRHHHRYSDQAEDIHSPLQKGFWWSHAGWILSDKYNDTRMEGIKDFARFPELVWLNRFHLVPSVLLAVALYFIGGFSMLVWGFFVSTTLLWHGTFTINSLSHIFGKRRYKTTDTSRNNWLLALLTLGEGWHNNHHFHQNTANQGWFWWEVDLSYYSLKVLSWFKVVEGLRLPSEATKFAFQKYTDEERAALAAPTRFWGASGARAQFVATKAAGDAARAASDAAKAAGDKVREALTTAADHLPTSAPPPSAMLKRR

SEQ ID NO: 16637 - protein, 255 aa, Myxococcus xanthus
GRFVHAALRASNRLRLPGPSVLPVAGAVVGLYSGLAAGIFSNLIGLVSGLTFGAASLKHTLRQDQFQSLMEAFAAARWHPEYAFIGVPLASGALLLARIIEPGGPRDEVKRRLRLLALLALGGLSLYYPLVALSALNSVFGHSHNLPEALPHLPWWLMLLAPTLGGVVVGRLLRDKPETHGHGVPEVVRAVKSGANALPADRGLLKLVASAITIGSGGSAGREGPIVYGGAAFASTVGRVLGFSRKELSILVACG

SEQ ID NO: 16638 - protein, 55 aa, Myxococcus xanthus
MLDARGLKDVDIEVDGGINATTAKRVVEAGATVLVAGSYVFGSKDYAEAIRSLRS

SEQ ID NO: 16639 - protein, 459 aa, Myxococcus xanthus
MLEALLENGMDVARLNFSHGSHEQHAENIAKLRAASLKVRKAVGILGDLQGPKIRTGRFVKGSTELKEGGTFHITTDETVPGTDEIVSTTYPFLAADVNPGDRILLDDGLLELKVLETDKQKLIRTQVIHGGTLKNNKGINLPGVAVRAEALTPKDREDLVFGIKAGVDYIALSFVRQPSDLDTARQAMAEVGRTVPIIAKLEKPEAIARLDAILDKTDGVMVARGDLGVEIPPEEVPAVQKDIIRRSNLRGLPVIVATQMLNSMIDNPRPTRAEASDVANAVFDGADAVMLSGETASGKFPIESVQMMERIILAAESSARTTQSLMRVLETPVGLPNHFPDVIARVACEAAKASNASLIAAFTLSGVTARLLSHYRPPVPIVAFSPNQEVRRRLSLLWGVVPRVLEPTQDTEAMVKRVEEELLARGLGRKGDRIVIVFGAPVGQPGKINSLRLHTIQG

SEQ ID NO: 16640 - protein, 247 aa, Myxococcus xanthus
MPQRNLPPDDAPRIVTRPPTREELWSRAESLAWRLSAELGMPVRLSVTDNRSTMVSFRRGSAVLALRLHHMFLDAPEPVVRAVADYAGRGHRTAGAILDEYIRGQQPRIRQMRRESDADLNPRGRCFDLQALYDATNRDFFQGLIQARIGWGRMPPRRRRKSIRLGVYDHQTREIRIHPALDTPEVPSFFVEFIIFHEMLHQLFPSTGRGGRRVHHPRAFRERERTFPHYAAALRWERENLGVLLRG

SEQ ID NO: 16641 - protein, 485 aa, Myxococcus xanthus
MSLRPVELEQVVAELAERLTGAVAQKAWCPLPRLAYVELRVPGKSILLCLCAEGDLARVSVADDRFPTPGEPAPFQRWLRQELTGFKLQGARFMEAERVVAFDFEREDVRRRLLLEGGAPGGLLLLSDTGRVLMLSGEGFAQRRGLHPGAAWTPPEPPPPEAREKARSQPSRLAPQDSDALPYSQAAERLLGARDKASRSETIRRRLAQPYRARLKRASRTLEKVRAEAARGPDAEKHREVGELLAQNLYLLKRGATEAVLTAYTEEGAKEVRVTLDPKRTPKEEADWHFHQYRRLLRGVEQARHREAELAREVAHAQQALTQIERMEDAALLSQAEVLQLPSGGEGAREGRPFKEYVGHGGARIWVGRGSEDNDALTFKVARPWHLWLHARGVPGSHVVLPLEKGQEVAQEVLLDAAHLALHHSGAKGEPRGEVSYVPAKFVRKVKGGAPGQVTFTREKTFVVRMEPERLERLLKSRHAEPPAP

SEQ ID NO: 16642 - protein, 79 aa, Myxococcus xanthus
MAAKKKTAAKSATKKAAKTAKATKAAKSAKKTTARKTAGKTATKKAAAKKTTRKAAKKAPARKRTTKAKTVAAPVTPES

SEQ ID NO: 16643 - protein, 337 aa, Myxococcus xanthus
MPQLGPYTLPNPYILAPMAGVSEMPFRVLAFRLGAALCPTELVSSQGLMRANQRTLKYLRYDAEVERPYSLQIYGGEPEAMARAAVVGREAGAQIIDINMGCPVKKVVKNGAGSGLLCDVPRAADIVRRIREATGLPVTCKIRSGWDARSLNYLQVAGALQEAGCAGLAIHPRTREQGYSGQADWSVIADLKRHFPELPIIGNGDVKTPADAARMLETTGCDFVMIGRAALGNPWIFRELLGGPPATPRERCELVLEHFRAHLDFMGDPLGAVRSFRKQLAWYAHGLYGAAAFRAEVNGLDLPSAVEDCVRRFFAAAHVDLAGPGEEQDVDYRAALG

SEQ ID NO: 16644 - protein, 156 aa, Myxococcus xanthus
MQAGMRLFVVRDLHAKLYYSERHALITSLNLIESSFNNSIEVGICISAGRAEYVRISDFIESEITPHRKEVPFKPATEPRRRSATPVPRHATQGFCIRCRDAIGFNPERPYCDSDFNVWRRYSDPTYEDNHCHHCGMDFAASKNKPLCRKCYGMLR

SEQ ID NO: 16645 - protein, 155 aa, Myxococcus xanthus
KERTCSLTCGEKKIPLTMLDGEPAAELLRKAAFQPNPQKFVPYALLRDTKGAYYFVDRGFHEAEKKNYRVFIGPRGNLKAQKMTNVISDSEGEIFSTKRGDLRLLLDKAKPAMWIENTKRRLELRQVPVDENLPLIYNELGVYEGARLGTPCDDQ

SEQ ID NO: 16646 - protein, 1278 aa, Myxococcus xanthus
MSSPFLSVPESQWVAANTFAFAIRDGFPVSPGHTLVIPRRQVATWFDASTEEQRAIFELVDEVKRGLDGELHPDGYNIGINVGAAAGQTVLHLHVHVIPRFQGDMDDPRGGVRHVIPGKGNYLAGRNKPLATGGLGDPFLHHLEPLFADAVEISVLAAFVQDSGLELLRESVEAALTRGATVRILTGDYLAITQADALRRLLDWMEEDAALQAEPGRGRFEARVVEVEKLQLTSFHPKSWRFLGTGLAVAYVGSSNISRAALKTGVEWNLRVERDRDPQAWNEVVDAFEGWWSRASPLDANWVEQYARRAPAARLRLPAGETEPEAPLPRREPHSLQRQALGALARGRREGRQRALVVLATGLGKTLLAALDVEQFNQERGRASRVLFLAHREELLVQAAETFRRQQHHLRFGWYVGQRAQLVGDVVFASVQKLSRPEDLHALRLAAAFDYVIVDEVHHATAASYRSILACVEPAFILGLTATPERADEGDVLGLFDDHLAWRSDLGEGIQEGLLAPFEYFGLKDTVPYENIPWKSRRFDVALLTQAVETEARMRTLWRAWQKHPASRTLVFCCSISHAHFVQQWLGGQGIRAVAVHAGAGSADRAQSLRQLANGTLDAICAVDLFNEGVDVPSIDRVVMLRPTESPVVFLQQLGRGLRKAKGKERVILIDFVGNHRLFLDRLRTLLAVGKPPVSLRDFLTSDRQPALPAGCTVEVELEAKEMLRHFLSGGGQEVERVYRELRDARGLRPTIGELYRRGYSPATLRKAHPGWFDFVRSEGDLTDGEARTLDKGRDWFKELELANMSQCFQMVVLEALLEADALEQGLPLPELARRCLAILQRSPELLRDLEAVKALGDPRLPNPARFLTYWKSNPIEAWTKGGKWFRVEEERFIPRLPMAPSTQKSFEAMTRELVDYRLAQYRRRQQAQAQDSAFDARVISNSRGPILKLPERSARSDLPLGTTAVRLDDGARWHFDFVKIAVNVARPDGAKQNQLPDLLRQWFGPTAGMPGTAFRVRFTLGPDGWSAAPVQAEPSPLAPWGTLVAFPSLRAAAGAVEHPISIDQAPEAARVRLPSRVQGEGLFAVRASGDSMDGGAHPIRDGDWLVMRDAKAAGAGRLDGRVALVQVPDPITGFRYQVKRLVRQDGHWLLRSDNPLRESFQAGEATSPVALVVEVIPPERLAPPLGTTLTEEQLSSHFGLSTAPRTGRHEGHLFLFIKDAQAFTSPGRLALRVPDHHPSETAFVFTQETASGDWTYQGAAVWRDDEDRWALELPRSG

SEQ ID NO: 16647 - protein, 56 aa, Myxococcus xanthus
MPSAIEAEVERQFNCSVIGRTDEIETCFYAITVERKIRHPAVVTIAEAARSHIFGE

SEQ ID NO: 16648 - protein, 436 aa, Myxococcus xanthus
MLDVVDIGKRSLATYRGIAPDEILDELHWLSEDLRGARCMHLSSTPYGGGVSEILRSLVPLYNDLGIVTDWKLIHGDDTFFQVTKRIHNGLQGAPGELTEREKATYLANAQLNAHRLVTNSENYDFVFVHDPQPAVLAALSPHLDARWIWRCHIDTSHPNPTFWDFLSPYLHAYDAAIFTMREFIPPQLPISDVRIYPPAIDPLSPKNHPLPEALARDVLEWIGIRTHRPLVTQVSRFDRWKDPLGVVRAYQRVRPHVPDLQLALAGSLAMDDPEGWDVYEELRAATAGDSLIHILTNLVGVGNIEVNALQAVSDVVVQKSLREGFGLVVAETLWKSTPVVGGRVGGIPMQLPEGTGGALVDTVEECAEAMLHLLRRPDEAHLLGARGHEHVRQHLLMPRLLVDHLRLLKHLAAVRPLPPRGIVPVSFNPASLQGV

SEQ ID NO: 16649 - protein, 85 aa, Myxococcus xanthus
ARKVENDAVAFAESIAQQRGRNVQWAASAVRDSVSVSADDARALRVVEYVTPTEADFLAQADGRQVTVAGGESVRLSTRDACRAH

SEQ ID NO: 16650 - protein, 102 aa, Myxococcus xanthus
FRQSLLWTSCLALLAGPVACAQTQGGKPVAKSAVSAAPKLGAGIESRTLKNGLKVIVWPDHDIPNVVLYNWFRVGSRNEYPGITGLSHFFEHMMFNGAKKYG

SEQ ID NO: 16651 - protein, 181 aa, Myxococcus xanthus
MDANAVAELEKAGVKVDQPERLYVAVEWDEDGKHVRPVGERVQIRAGEQLAYVTLKPISQLFVGDVKPPSFAKAPPPEYQPFFLLIEATAAGYCRAVRNTETDQEFERLYRHLLRRPDGTDRNPLFSHLQGAVRLYMSLRDVSQAEFEAVIQRLHQSARHFQTHTGSINYFQEVLREVLGA

SEQ ID NO: 16652 - protein, 264 aa, Myxococcus xanthus
MEAINLNVSFESPELVVPAEVAEARVREHLKLVRRLAWKYRWTGLSMEELVAEGNVGLMEAAGRFEERGVPFAAYASQWIRARIRAYVGRNWSMAGGRAPWVVFQLRRERSRLEARWGEGHPEVEKRLAEALGKREDEVALAMEALSRDVSLDAPVSPDSEATRLEGLMADADSQEDQVDRAKWARRLRASVDAAWPELDARERALVEERMLAEDGVSAELLARRFGVTAVRIRQIEQGLRVKLRHRLTAGLTSWDGEAMSLAA

SEQ ID NO: 16653 - protein, 42 aa, Myxococcus xanthus
MDADFVALSEEPLEALASALVKAQVLATVVAGTEVYRAPPRA

SEQ ID NO: 16654 - protein, 30 aa, Myxococcus xanthus
RLLLEGREVTGYQLGAVGSLPSERGRGLAR

SEQ ID NO: 16655 - protein, 341 aa, Myxococcus xanthus
MYSLNAGAFGYMGGAATGRPLAGATSLSGLSFDYAHMLNPVLLDSSRGDVFSLAQMRLQTSANGVSYRAMHKVLNASMTQVEGQPTTVNGTFTQPVATGTFEVDWRRSAFEAMRTQVNPGAVSTYNEIWMSARPAALSSAFASISGPPLLVKLNPDAQRTDIVTGSMTYNNPLPAAWQKVATAVAGFTQSYALGTATPYTMNVDIRVEQEASAFTAAPVEPLVGPVQAPLVNTRGAFQNLTGVGTDASLRWSKPLIGTATNYVVNIYRLGTSNGSTTATRVAMLHTDLQSVYLPPDVLRAGGTYFAEIQSWYQPGSNLATSPFKRSLPRGRASVLTGMFSP

SEQ ID NO: 16656 - protein, 377 aa, Myxococcus xanthus
MAAVADIMMQSYALSPADIAAWVQRVSRPDLRLLREGGEVAATLVFIRMGQWYGGRSVPVIGVGGVGVSPVHRGRGTATRLMQHLLREARATGAPLSVLYPATQPLYRRVGYEHAGTRQEIRIQVPSLNFSERTLSLRAIEEKDTQAIVLSYQRHARHRPGWLDRGDFSWGRVRNMRGEVAHGYLVEGSAGVEGYLYVIRRQLKDFNQELFLTDVVAHTPAAARRILSFLGDHRSLATDVFWYGGVDDPLLLLLREQTYAVKQATHWMVRVLDVASALEARGWPEGLSGTLHLDVEDDLFPENQGRFVLEVSDGQARVRRGGDGGLRLHVRYLAPLYTGHLSAASLRAMGALEGDDASVRAAGSLFAGAPPSLRDMF

SEQ ID NO: 16657 - protein, 66 aa, Myxococcus xanthus
MYASTSPRRTCLSEAVPQSGSGGYHGQPSFDAFSHRKGVVKRPFLLDLKLRYPPYTGKLGLFKRFL

SEQ ID NO: 16658 - protein, 725 aa, Myxococcus xanthus
MSEQNTIRWDKDADGIVVLTLDDPNQSANTMNAAYLKSMRATVDRLVKEKDTVAGVILTSAKKTFFAGGDLKDLLKVRKEDAKQAFELGQEIKAQLRTLETLGKPVVAAINGAALGGGLEIALACHHRIIADVKGAQVGLPEVTLGLLPGGGGVVRTVRMLGIVDALMKVLLQGQRYRPQEAKEAGLVHEVVDSVEALLPAAKAWVKAHPTAQQPWDQKGYKIPGGTPSSPGLAANLPAFPANLRKQLKGANMPAPRAIMATAVESTQVDVDTAFTVESRYFTELVTGQVAKNMIQAFFFDMQHINSGGGRPKGYPQHTAKKVGVLGAGMMGAGIAYVCAKAGIDVVLKDVSLASAEKGKQYSVKLVEKAIQKGKSTKQKGDALLARIPPTTDAADLKGCDLVIEAVFEDVKLKHQVFQKVQDVVAPDAVLGSNTSTLPISVLAEGVKRTEDFVGMHFFSPVDKMPLLELIAGKKTSDATLAKAIDIAVQIGKTPIVVNDSRGFFTSRVIGTFLNEAIAMVGEGISPASVEQAGLQAGYPAAPLQLVDELTLTLPRKIRQETKAAILAEGKPWVEHRSYAVMDAMIDQHQRKGRSTGGGFYDYVDGKRTGLWAGLAQHFTKPGHTIPFEDMKERMLFAEAVDTVRCFDEGVLRSAADANIGSILGIGFPAWTGGVAQFINGYEGRTGNGPRGFIARARELAQRYGAHFEPPASLVEMAERGEFLK

SEQ ID NO: 16659 - protein, 303 aa, Myxococcus xanthus
MAAQQVRSGWEHLVIAGGVESMSRVPMGSDGGAWAMDPATNFDTYFVPQGISADLIATIEGFTREDVDRYAARSQQLAAQAWAGGYFKNSVVPVVDQNGLTVLDHDELMRPDSTVASLGKLNPSFSVMGEAGGFDAVALQKYHFVERIEHVHTPGNSSGIVDGAALVLIGSEQVGKSLGLTPRARIAAVATSGSDPTIMLTGPIPATQKLLEIAGLSVKDIDLFELNEAFASVVLKYQKDLGIPDEKLNVNGGAIAMGHPLGATGAMILGTMVDELERRKARRAVITLCVGGGMGVATLIERV

SEQ ID NO: 16660 - protein, 296 aa, Myxococcus xanthus
MDTASETLGTQSDALVSSNGLSTNGLSTNGLSTNGLSTNGLSTNGLSTNGLSTNGLSTNGFSTWFSADPVKAEEVMRYIVRCALASGQSLTYTHAGTTHTWQGSLGLAPTWSNPTPPPPSSPGAPVAPEPEQQLVSSCLAAHVNKYGVHLNISVQGKDSQGVVIPTTAEEVQTYNQNEAVFFGNLFNGQGLFAANDAPYLAYDESTVRACGLSSWSGDPDCAAVITHVGAALTYCQQDSTRTYYTRCTYNGVTYRPLTTRIRPQDIYKCGDGTCQLSESCGTSNTPDSCAADCGAC

SEQ ID NO: 16661 - protein, 36 aa, Myxococcus xanthus
MLVGKTRQRPEMVIENLRQMRTYFQAIQARLTPGAS

SEQ ID NO: 16662 - protein, 158 aa, Myxococcus xanthus
MQKITPFLWFDGNAEEAMKFYVSVFKKDAKILSLNRAGDSDTAPVVSGTFQLHGQQFMALNGGPHYKFTEAISLFVDCQTQEEVDELWSKLLEGGGQTQQCGWLKDRFGLSWQIIPSVLGKMLNDKDPEKARRVMEAMLGMVKLDIQGLQRAYDGADP

SEQ ID NO: 16663 - protein, 33 aa, Myxococcus xanthus
MGDLLTEAQRPASEKLNLIYARLELAQARQGEG

SEQ ID NO: 16664 - protein, 121 aa, Myxococcus xanthus
MLLAAEKGRGGEAYFLTDGEPVEFRGFITAMLATQGVDAGERTLPYGVAATVASVGDLLWGTFGLGGRPPLTRTEVLLMGREVTVRDDKARRELGYEGRRSREEGLREMKAEHQDTASRML

SEQ ID NO: 16665 - protein, 249 aa, Myxococcus xanthus
MQPKGRVLRYAVNDMTAATQGDGVARFLPLDAGTYTVTVDGLSAVDDLLLNPGAREQPVILNTCPVCLVPVEVGARPEFLLQWKHDAAGVSGVELTLGDAHPLAQATGTSGLAGWSGEPLVPGPYPLALRFAGGGKFQLYSATGQLLDAAPVLNIPAGRFRFHYQVQQLGQLKLAVQLQQPDGTMAPIDRPHVTVQWPPSASPKEWVLDQGVSEDIPLVNGPQTALTLDALELEDDGAPEVFEFMALNP

SEQ ID NO: 16666 - protein, 1050 aa, Myxococcus xanthus
MPPVFARRSDSNKIDVTHRQTLGELLDTNGLTGRLNDVALYNWGTLVPAEINRALIELVGCASPETDPLASLLDPALGPKPFIHKPEPWKPAAPLALDTSHTVQVRRRFPAPAVSIRKLTRWFLPSSGTCETEYMLEGVASSADKVDFEVHAHGYHSLSPQGGQVACDTDATEGGSMHLFRRRKCYEVADRRPPAVAQQLPDWKGESEATQGVLKREGTGTFIHHGCAPYDVLVRYYKDDRDNAAKILLTPFAPRWKPVKGADPELDEDTLSVSWELQGDHGKLKRGQLVVWDKDDNVVFFAPLDEQQLRTRKRYEFLKDARKTWDKAAIRRDQLPYRVQLQAHSDEDEPQGLALAVMPTQVRAFDYAQVQFIAFNVKPGTKPRVPGPGIDYLGDADPDVDIQTRCDVMKDAIRLAAADGHIRPEENVLKLFMAPEFYFRGKDGGYPVEKLWDVTRQLRQETDKLEYADWLFVVGSAIGYLPHEELDAVTGAPTGTPLTHGGEGEVHSVLLEADTSGVDDVLKVRLSRPPDTTWKVRERGKNYALNAVATTLTPGEYQLTVDGKSGLAPGPIVLSEPVAWIDTVDQTGACTEVVVNSRVCSRIFIPSSGAAPAAPWKLRTGSEEDDIKGCVPLGAGRYRLTLANKKVGFASGSAELVEPRSTEVFNVVMVQKGWPAPLLSQGLKGAAVYKEYVSAIDFVGPNSHNANAWFDATGLGRRIEIHGATDRLALPTEGSTDVPAASPNRVGLGATWLNRPNRVGSEINLSGDGGGSVVTVDGVTLGLEVCLDHAMNRLDLFYHGGNSPVPPFGPQAPGAVAGDPRVQVQLIPSFGMSIGRGKLCTLIGGPRPGLVFNVDGQRCASVARVTDGAYSCDDHPAMHATAPGFCTHDKELRWCVGCNKMRSAPGDCPTHGPTEARHLCGYPWQRWQCGVVGCTNTMPCLAHPYPPAPPPLGFNWCLKCSKEFPMGPPCPTCGGPPAPCSEPYMAGATCPRHAPAFAQRCNAPLVSMGQSIATVSGPTQVNSSHDPAFFGEGGHVLVYPAQVLPRPDVF

SEQ ID NO: 16667 - protein, 492 aa, Myxococcus xanthus
NPRTQVFDVDGAQVRITTEVSLAGLTAPLVVDPGWSSTAAMAEARAQHTGLLLGTGQLLVVGGVNRLGFVASSERYDPETDTWSAAAAAGISGNVTLSARLSDGRALVLADGSTSGRIYDPATDTWSATGPMAAPRPLATLTRLGSGQFLIAGGSNLATAELYDPASNTFLPTGSLLSVRRAHTATLLRSGQVLAVSGFNNVNDEVPGADLYDPVAGTWTAAAPPLVPRHYATATLLPDGRVLLVGGFTSGGIVTTHAELYDPTANTWTATGGLNFARNGHTATLLPDGRVLVVGGSNAARDAQPASELYDPATGTWTLAGSMATGRENSTTTLLPSGKVLTAGGFHSNPSTTFYADTEVYDPGVQGWAAAGTLGGPRIDPLMALLPTNRVLVAGGRDGAGTALASASLYDRTTNAWSATAGLSTARADATATTLASGELLVVGGTNAGGTLNSAERYSPTTNTWSPAGLLTRARHLHTGTRLPDGRVLVVG

SEQ ID NO: 16668 - protein, 171 aa, Myxococcus xanthus
MDLHTSYIFPTPHTYNTLAKPNFTKIVKFKLGNWLFDAMNIDVNINALRFNLTQAQINSFVNNQLNQFIGGQLNNVWAGIERGIINAIDPTYISRYAEYTKKVNSLKEQNRFRITLGKAEKHRGYSHKNSWTFDWNVAVGQSTYSYDMKAGSFLGRARVGCSWHGIRIVRQ

SEQ ID NO: 16669 - protein, 515 aa, Myxococcus xanthus
MNRKPDVYTLILTSWAALAVGCGTPSEPPTSTASTEAGFTAQVEEANEVSEDVSTEGLDTALSSSATVLGRFSRYCGKVNSHQSPGGTWTADPDCTSGCNIGGLAYCQKFWPGSTAIRQVAVSSKPNNAWRTAGCGVIVDDYDGTDEFECTVEPYCGDGICHTDNGESPSTCAADCGTCGDNVCNNGENYIVCSEDCGPSSACGDGACNNGETHATCAADCVAPALVTTPDFPTGVLQFATEEAFNSLYHALEATPAAASSLPNGFNHLKGHLSQFPINETTYEVDRAEYLRDLKFHIIPDEGLQYLVNPDMQVLAGGKLYQFTDIGLFQVDLNNLAWFKTWLAANQERIDFDPNFKTVPGEVDLGDGRYQVSTGVVRIDMLKEKMAGSDTTPDPTETVLGRFSRYCGKVNSHQSPGGTWTGGPRLHLGLQHRRPLLLPEVLAGLHRHPPGSPSPRSPTTPGGRPAVASSSTTTTAPTSSNAWPTPPSPPRWRRSSSRANQVATSATRRCPPINC

SEQ ID NO: 16670 - protein, 157 aa, Myxococcus xanthus
MARRYFDFREDEALHAHLADGRRFIESPGAPYDVIILDAYGTRSIPPALATQEFLRATQARLTPDGVVVGNVLRKSGRPGSLMDPLWQASFPQLYAFDVQASDNRILVGLPHARRLLRARLLARAGQLARKWGVPFNLRARVARRVSGSRGPANSHG

SEQ ID NO: 16671 - protein, 99 aa, Myxococcus xanthus
MNVDAFIVVKIQGTYEGDAPLKLKLLVSAPKESSEAAGDRPAWKVTQTRDLAVLTENGVTQVPFILPYHCASTVKVTATLTGGGLKASKTLDTSFPCAE

SEQ ID NO: 16672 - protein, 526 aa, Myxococcus xanthus
MNLSRAALLVLLQPLAVQAAEYRVGPDQQYTRLGDVPWESLEPGDTVFVHARPTPYAEKWVLGRRGTAAAPITVRGVKDAQGNLPVIVGENATTRSQLNYWGEERGILKIGGSNRPADTMPAHLVVENLHLRRARGAFTGRNGASTYLDNAAAIFIEKGEHITIRGCVLEDSGNGLFVANQASNVTVEHSYILGNGNTGSILEHNAYTEALGITYQFNRFGPLCSGCLGNNLKDRSAGSLIRYNWIEGGNRQLDLVDSSSGTLRAAPSYARTFVYGNVLLEPEGAGNRQIVHFGGDSGNTANYRGTLYFFHNTVVSSRTDRTTLLRLSHQNQTAHVTNNVVLVASANGNTLSLTDEAGTLRHGGNWYKPGYVSTFGTLTGAVVDAGGNLTGTDPGFISLAGQDFRLAAASALRSQAVALPAETSSEPVTWQYVKHTAGEPRAQVSPAHIGAYGDASEPGTETPDAGTGTEPDAGTGTPTDAGTTPQPDDAESSGGCAAAGASFAGPLAFAILGILGRRRRNPARGQ

SEQ ID NO: 16673 - protein, 65 aa, Myxococcus xanthus
DPRTLTGDTLRFEQALGSNPAAPLTGVISYDAPSQSVSFRVSPLPAPGALVTGTLSTGAKDLAGN

SEQ ID NO: 16674 - protein, 419 aa, Myxococcus xanthus
MTESRDIRIEHLLREHAPRVLGAVIRRFRDFGASEDAVQEALLAAALQWPREGVPDDPRAWLIQVASRRITDHVRAETARRHREELVVSLVPPELQLVMSLDGDELAGRDDALVLLFMCCHPALSTASAIALTLRAVGGLTTAEIAKAFLVPEATMAQRISRAKQSIKSSGIPFQKPTPEESAQRLGAVLHVLYLIFNEGYTATSGPELHRTDLSGEAIRLTRMLHTLLPEDGEVAGLLALMLLTDARRAARTGPAGELIPLDAQDRSLWDAGMIAEGIALISATLSRGSVGMYQVQAAIAAVHDEASRAEDTDWPQVLALYGVLMGLMDNPMVALNHAIATAMVHGPQAGLSLLEGLAREGRLEGNHRLDAVRAHLLERAGKTGAAVVHYRKAAERTTSLPERDYLLTQAARLSDEMA

SEQ ID NO: 16675 - protein, 288 aa, Myxococcus xanthus
MRRFEFVEGSSSKFWEPELKGNTFIVTFGRIGTAGQRREKAFADEAGARKEYEKKVAEKLREGYLEVTEGGAAEAAPASAPPPAPKKAELPRRVPAATPTPESLKAAAEALAALRARLGWRSWEVTSRARRAKRALRALGGVDPAAHSELAGTFTALMERVVAPKKDGRLPLRHALALLGELDVAAFTRAAEVWLAAPDAVPAATTVARQASALGQPELALRMGMLLAERPGQAGAPSEEGWSKRWTRLRPHVEEQLSSSGGSLASWAQSVDASKDAHLASRLARLEA

SEQ ID NO: 16676 - protein, 128 aa, Myxococcus xanthus
MLMMNTPSGGPYQVMSWPKKDLQAHIAFMAGFATKLGETGELVAAEGLAGPDQAKRVRAGADGKPITDGVFPESKEFLAGYWIIEVDSPERAYAIAAEASAAPGLGGKPMNMPIEVRQVMSGPPPDLM

SEQ ID NO: 16677 - protein, 580 aa, Myxococcus xanthus
MGRFDTQVLAAVEQQIGRDTAVSEADRQAALDFYRAVPASMACLSGDPELASYRNSLGKACADLNQFNWASLASWGLLALGLASTVVALLCGLAAFVSRPFQFGSFVVGWLVLRVTSAIQVLGQGALLVWLSYWMTALWMERYYPKLIGIMALLAGGAVFLVVVAIFRRPPSDFDVEAEAITEARAPELWACVRRLCERLQTAPPDNILAGIDANFFVTEHEVRVGERTLTGRTLFVSLSLLRLLERSEAEAVLAHEMGHLLGGDTGHSKRLAPKLAHFGHYLQQLYDGGMTRPVFYFMMAYRGLFELSLGRSRRASELAADRLAAGVTSGQDIARSLVKVGAYASFRDRVEAKLFAQDEQHQTVAIADRVAHGFSAYAQSDTVHDDLQGAVTPHPFDSHPPLAARMENVGAHLNPEDMVRLLLEPVTSSWADTVQDADAIEARLWGAYEARFAQAHDLSLAYRYEPSTEEERAHVEKHFPPLVFEGKEAGFDVQMDYAQVSYGDWEAPILFEQIASATTADRMFKKYLDLEVPGEGRFKSRRSICLSKLREPDALLQAFERYLSRHRIMKEHLAGAQAA

SEQ ID NO: 16678 - protein, 52 aa, Myxococcus xanthus
MPKVGGKNDGCTVGNLPEYSFGCGANGYLRGLVVDSANTSMYVGYVLDRSCR

SEQ ID NO: 16679 - protein, 140 aa, Myxococcus xanthus
MGERPREAGRPPSTDVAQVFANSRPANWSVPENAGRRYARASGDYNPIHLYGFTARPFGFPRAIVHGMWTVGRCVAEMGEAAEAPALTLSSEFRRPLLLPSRVIFQTAPQPEGAVAYRVMAEDGQLHLLGRLSPGASPAR

SEQ ID NO: 16680 - protein, 190 aa, Myxococcus xanthus
MKKVAALACLLALLGAIPSQAAELKDVFGREVPVGKGRPTLVLYANRGSRAELRQHAYSFIYELREERPIVLIHVDLRDVPGLFKGMARGEIKKSHRESIEHMRNIFRQHGEAPPPELESSLFMVADAKGEPHQAMGLKKGFGQVVAKVLSPSGRELARGPFPESARKLGQTMASASESLSTLRVVDMSR

SEQ ID NO: 16681 - protein, 60 aa, Myxococcus xanthus
MSTSAYVFWAVVPEARRGFVIWSYGATTYTCRSEEPNCTLIFAFRTNSRANRPGDYNLCS

SEQ ID NO: 16682 - protein, 131 aa, Myxococcus xanthus
MLPGKHIEGDGLILELPGFVMNVVTPSAHEFFKLPADKKLTLPLRANLTLMCGCPTEPKGLWDSSRYELQATVKHNGKPLTQLPLKYAGKTSTFEAALSVQQQGIYEVTVTAYDPITGNTGVDYTTFIVES

SEQ ID NO: 16683 - protein, 471 aa, Myxococcus xanthus
MLAAELALAQVDVAIVERRVSQEVAGSRARGLHARSLEVLDQRGVVERFTSQGQAVQNVAFGQAHLDLSDFPTRHNHGLALLQERFERILAEWVGELAVPIYRGCEVTGFTQDDTGVDVELSDGRALRAKHLVGCDGGRSLVRKAAGIEFPGWDASISYLIAEVEMTGAPAFGIRRDEKGTYAMGKLEDGRVGVVLREERVGTGDAPTLEGLREGLVALYGTDYGLRSATHLSRFTDMTRQAASYRDRRVLLAGDAAHVHSPMGGQGLNLGVQDAVNLGWKLAQVVRGVSPESLLDTYQAERHPVAARALRKTMAQTALSRGDARMDAVRETLAELLGMDGPRKQYAAMMSGLDVHYDLGNGHPLLGRRMPDLDLVTADGPRRVFHLLHDARPVLLNLGEPGTLDITPWGDRVRRVAARYTGEWELPALGAVTAPVAVLIRPDGHAAWVGEGTDQGLREALARWFGPPRAT

SEQ ID NO: 16684 - protein, 101 aa, Myxococcus xanthus
ANGGAPAIEGSTVYALSGLGQCLRALDLASGKERWLYETGGALWGTPAVADGVVCFTGYHGILHALDQDTGKEIWSVALDNPPKDTGSPDESQGGVRLHGG

SEQ ID NO: 16685 - protein, 63 aa, Myxococcus xanthus
MLGTTRLDTALGAPIAPGVWQQVTIPLSSIGATTGTLRDIYFQDDSGTDQPALYLDDVVLLPQ

SEQ ID NO: 16686 - protein, 400 aa, Myxococcus xanthus
MKPAVLIIIGVLTALGGALYLSSRRAAERTEEARPAAQAPVSTRAVRTEITFLYSTEKKAWVEEAAADFQKAHPLIRVNLVGRGSLEAARAILEGSERPTVWSPADSAVLRMLESDWATDATREPLFATEGEAAPRPLVKTPLVFVAWEDRAEVLQRASGGGAVSWKVIHDAVSSDQGWPAVGGQPEWGFVKLGHTDPTRSNSGLQALLLASLEFYGKQSGLTVADLLEPRFQTWLSQLERGTGRFEQSTGTLMADMVRFGPSRYDIAVVYENLAIAQLSQPQGTWGALKVLYPTLTSWSDHPAAVLDGDWVLPRQREAALEWLRYLHSRPVQQRALAFGFRPADASVPLTPPGEASLFPPLAARGLQVDVPDGAAVPDGAVVRNLLTLWTRWVGNARSP

SEQ ID NO: 16687 - protein, 187 aa, Myxococcus xanthus
MYLGWAQRRGYEAVAVAEAEEPSRVVVRIAGPGAYGFLAGEAGMHRRLEDEKRQRAYVRVHRGGSLSEEELAYLEVQGRPMKSHEGAYLQRVRTEVTVKDESSGRVLTLTGATELDELKDIAARVVYGQGSNTDEARRYYLGRGARVEDPRTGAGTPRVKDVLRGELDVFIAAWITRPPTEPPAPGS

SEQ ID NO: 16688 - protein, 669 aa, Myxococcus xanthus
MATRKSEDQERLIDRDLTALAREGKLPAAHGVDAAVTEVLGLLTRGGKHPLLAGEPGVGKSALVQEVARRIAEGRVDAELANARVVEVSVANILARSTQRQAAESFEELLAYLSRHPRPIVYIRDLPAALGGPLAPVAVRGLRTGGLRFIFETEPKRVQELLRSDEALAERLHLLPLHEPPTEKARWVLGRVAEELERELRLPIDPAACDLALRLSSKFLLAQRMPRKAIELLKETAAEAASAAKDHVGPEDVLTRFCAATRLPRFVVDDAMPLDLDETERFFGERLLGQTDAVGAVLRSVALLKAGLNDPRRPLGVFLFAGPTGVGKTQLAKLLAEYLFGSADRLVRLNMADYPNDGDESVPFGATWAPALETRRGELSALLDGKVFTVLLLDEFEKAARSVHDRFLQLFDEGTFVNGAGETVSCNNTLIVATSNVGAEVYRESGMGFTGARRAEEMVPEVDRRIGEAFRPEFLNRFDAICHFRPLSKVDIRKIAQREVGRVLEREGIRARALDVEVTPAVVDLLVERGYSPQFGARYLQREIEKTLTAALAVEIARRPLPPGTPVRVEARLGGRVTAVAEPAAPPPSPTAQLLLPSARAAPVKRRLDRKSLLFEMDRLVGKARALADSAGRPQLEQRRAELLAETQAPSIWYDPTRATEVICAFSAV

SEQ ID NO: 16689 - protein, 197 aa, Myxococcus xanthus
MGRWVTAGWVLLGVAGGVGVGCGSNDSAQKEPPGGEQAQIPVGAEDQERIDIGLRISPVPLKLEGLDRNLVGLGSYILNAQTGCSDCHTQPGYLPGGDPHQGEPEQINTTNFLAGGKPFGPGLVSSNITPDAQGLPGGMTFEAFLALMRTGREHGAIIPVMPWPTYAKMRDQDLKAVYEYLRAIPPAQPGMAPPPAP

SEQ ID NO: 16690 - protein, 158 aa, Myxococcus xanthus
MLIVQGKVEVVEEYEDRVVRSVTVEIRMPSVIRFIRGLRRRPKGVKFSRENVYLRDHCRCQYCGIKVTRPEATYDHVLPRAQGGKTSWENIVIACVPCNQKKGNRTPEQARMALRTAPMKPKKVPEAMHLTFLFEKGMPMSWAKFLRDVAYWHVELQE

SEQ ID NO: 16691 - protein, 103 aa, Myxococcus xanthus
MRSDAAAAYNRMYAAARAQGITLKVNSGFRSMAEQEALYRAYKNGTGNLAAPPGYSNHQGGIAVDVNTGGTGTSTYRWMANNAKNFGFVRTVPSEPWHWEYRP

SEQ ID NO: 16692 - protein, 330 aa, Myxococcus xanthus
MTAAYADPAGHPELREAVARHVGVSRGVRAEASDVLITHGAQQALDLAGRVLLEPGDRVAVEEPGYPPARLLFQSLGAHVVPVPVDKEGLDVQALPDDTRLVYVTPSHQFPLGIVMSPARRRALLDWARRRDAVVIEDDYDSEFRFGGRPLETLHSLDRSGRVLYVGSFSKVLLPALRLGFLVAPPSLQRELRLAKQVTDWHSQLPAQAALARFIDTGALARHLRKTRREYEQRHTRLSEKLRHHFGDALEQLPSVAGLHLCVTFTRGGARLERELTRRARDAGIGIEALSGYFAGAPTRHGWVLGYGGVTVDRIDEGLWRLRTRLAGAL

SEQ ID NO: 16693 - protein, 276 aa, Myxococcus xanthus
MFSSQTFFFAVVGDVHGHMHQMVSHLTAWEERSRRPLDFVLQVGDFEPHRHNADLATMAAPTKYRHLGDFAAYHQRRRRFPWPVYFIGGNHEPYGHLDLYPEGFALAPHCHYLGRSGVVELNGLRVAGLSGIHREATFCKSRPPLASMGDVSNKDFTFFNEEDVERVLALGRADVLLLHDWPSGIIPPEEAADFQGQRRGASHDLVGNAYARLLVDALQPRLVLCGHLHRRYAGTVQHPGGQRSLVRCLASVEQGAEAFAVFQCREGTLQEIAMWE

SEQ ID NO: 16694 - protein, 489 aa, Myxococcus xanthus
AVPFGKYELLRKIASGGMGQVFLAREHGTGFERLVVLKLILPHLAEDDEFLSMFLDEAGLVARLTHPNLITILDLTEIEGRHCLAMEYVQGDDVRRLEKTSRAQGKALPVGLILRIIADAAAGLDYAHQARDAQGKPLRLVHRDVSPQNILVGFDGGVKVIDFGVAKAATSSQNTATGVLKGKYPYMSPEQASGLAIDARSDLFALGVVMWELLTGKRLFKGESDMMTLRLVKDCQVPRPSQLNPRLPPGLDEVVLKALAPSPDQRYPDCGAFRLALEDYALNLRLPSSSAHLAAFLRELYADRIAHETDPAKLDQLAEDADLDSRSNSSLSGVPGLLGPAGRSSASRAMRGSPHGAVPGTRSRQTAAAPQPKEKTRGTAPLARPPPEPARRIPWLPVATAGLGLLIAGAGIVFFRSPADATPARPPVEVAVPHQPEIAPEAQPPPSMDPEPARHVKLPVITEPPGARVSVNGEERGETPLRLELEAGV

SEQ ID NO: 16695 - protein, 300 aa, Myxococcus xanthus
SRILVIEDEPIIRTELRRLLVRAGHDVSEAGSVHEASSDYPLDSFDLVLSDLRLPGAPGTDIIVMCPGVPVLIMTSYATVKSAVDAMKLGAVDYIAKPFDHDELLMQVERVLREGLLTRQNAALKREVEQAHPVSGMVGNSAAMREVFERVRKVAPSPATVLVLGESGTGKELVARALHAQSPRADGPLVAVNCAAIPEGLLESELFGHEKGAFTGAQAAHPGLVEAAHGGTLFLDEIGELPAPAQARLLRMLQHGEVRRVGATRPRKVDVRIVAATHRDLPRRVQEGSFRQDLYFRLRV

SEQ ID NO: 16696 - protein, 196 aa, Myxococcus xanthus
NFVFISPHFPPHYFHFISALRERGVTVLGIGDASYESLRPELKASLREYYFVPSLMDEDALTRAAGYLTWRHGRIHRIDSLNESWLEVEARLRGDFNVPGLQPEDIHRLRSKSGMAEVFHEAGVPHPDLIRVRDAAQVMAFAARVGYPLVLKPDVGVGAANTFKVASDEEVGRGPVPSAAHHLCGAVLRARHHRHL

SEQ ID NO: 16697 - protein, 543 aa, Myxococcus xanthus
MEPLMTGSNSYRIRQGDTLSAIARRNNTTVDALARANNLQSPDRIIAGKTLVIPGANDGFEANAPRPMPRPANRPTGTSQNRDSFEPGTAQGTVAQGVTPAGTAGVSGTQNGYRNVDLTAFRQGGSNSESAIVVGTSEGNRTPNGGFTASYGGHTDPGNAKHNRGSFSYQGGGANSPSHADEIWNRELGRVTPQYQRAAERAGLDPNNALLASTFYDLHTQSPRAAQNFLNRELPRLAQDPRGVTPEALVDARVNAFRTDNGQISASGFDHNEQRLRADQTRRETALVRALDARGFRDGGGGGGAVENAPIPRPRPENLTAGTTALPAEVPIPRPRPENLQASNTTGGATPTDLNDTAEIAPAADRPAVHTATPWVSQYNASKVERAGDKACFRAAVVMAAGAGATVTGPDNRIQVATGDDPNGGVTVNAAAARRGREYIDGQLDAGKPVVVGVDHRSGRNSDNVDGITDHFVVITGRGTDEQGRTYYTFHDPATNHQQRGADTNPNNRFYVDQDTGNLYREGPTNGNVVQRHFEVSMVRPNA

SEQ ID NO: 16698 - protein, 138 aa, Myxococcus xanthus
MVDARAIVSLVIYPQPLGLLAEFNLGRGPSLGEGPVEGLLIDSRRLRGGYAQLMYKLDGVLGVSLIPYIRGTLYDGGKKFETNAPLYDVRELEMGAEWQLNKALELTGTYLISDRTSSRYPYIQEQGHVTRIQLQVNY

SEQ ID NO: 16699 - protein, 174 aa, Myxococcus xanthus
MPEPETKPQAKKEERAWYDRIRIRGYTQFRYNRLPSFRVNDELVNDQGDRFLGKNTGFGIRRARLVLFGDVHDRVSIYLQPDFASVIGDQYNVTIMRDWYADIFLDAKKEFRLRVGQSKVPYGFENLQSSQNRLALDRNDAINSGLKDERDLASSSTGRPTKSGSASSSSWTTT

SEQ ID NO: 16700 - protein, 305 aa, Myxococcus xanthus
MKGSFAKRITLFVLTNLAVVAMLAIVGQLIGVENLLARRGVGLNLPGLLIMAAVMGFGGAIFSLLISKPMAKWSTGAKVITSPRSEDERWLVETVHRLARDAGIGMPDVAIYDSPDMNAFATGARRNSALVAVSTGLLHGMKRDEVEAVLGHEVAHVANGDMVTLTLLQGVLNTFVIFLSRVVGFFVDRFLSRSDDGEESGGSGPAYFITSIVLQIVFGIGASMIVAWYSRRREFRADDGGAQLVDPGAMARALNRLRMQQGEPAMLPSNMQAFGIRGGGMMALFSSHPPLELRIQRLMDGSWKR

SEQ ID NO: 16701 - protein, 551 aa, Myxococcus xanthus
MQDLRKVKNGKEILKGIYLSFFPGAKIGVIGPNGSGKSTLLRIMAGVDTEFFGVAKPDPSAKVGYLAQEPQLDASLDVKGNVELGLKEIRATLDRFNEVSAKFAEPMSDAEMEKLLAEQGRLQDAIDAVNGWELDRTIEMAMDALRLPPGDADVTKLSGGEKRRVALCRILLEKPDLLLLDEPTNHLDAESVAWLEQALKEYKGTIVCITHDRYFLDNAAEWILELDRGEGVPWKGNYSSWLEQKQKRLELEEKSESHRQKTLKRELEWVRASPKARQAKSKARIAAYEELLNQTQDKRDATGEVIIPPGPQLGGLVVEAKGLRKAYGDRLLIEDLNFKLPRGGIVGVIGPNGAGKTTLFRMMTGVEKPDEGELNIGETVKLAYVDQSRDALDGDNSVFQEVSGGLDHLDLGKAGQVPSRAYLAGFAFKGQDQQKRVKDLSGGERNRVHLAKMLKSGGNLLLLDEPTNDLDVETLRSLEDALLGFAGCAVVISHDRWFLDRIATHILAFEGDSKAFFFEGNFEDYEADKKKRLGPEALEPHRIRYRPITKS

SEQ ID NO: 16702 - protein, 131 aa, Myxococcus xanthus
MGPAGLSFKPLRFFQDGSGWMYLFRLEPGTVIPRHRHTGEAHGFNLSGTRELLDTGEVIGPGGYVYEPPGNVDSWRVTGDAPAVLLITVRGAIEYLTEDGQVSKRVTSEERLQTYRRWCEANSAPFLATLE

SEQ ID NO: 16703 - protein, 359 aa, Myxococcus xanthus
ALVLNGSPHATRYRDEAFFVDAVLTAPGSPVEVATRDAEVGLREDFSAYDLVLLLNVPAPSADEAQKLAAFVENGGGLFISMGDRVNPEAYNQRLGPVLPRPLRLVRTSAERDDPDADTKSARLAQVSVEHVLFSPFTGQAEEGLVGARFYKYMLLEADSPGAGGASQVLATYEDGAPAVAVARKGKGRVALLTSTVDRDWSDFSIRTSFLPLMQRFAAYLTGSLDEREEVRVRVGESATLRPEGAQKVSSVRAPDGTEVTVKEQPEGALVAGPVTEPGVYSVLGADGKVQPDLSFAAVLDPSESDLGRVPTDTLTAYFGEETVKASTGDADKPTVPLWTWLILAACLAFFFEGTLLRK

SEQ ID NO: 16704 - protein, 196 aa, Myxococcus xanthus
MTFSTFGIGCGPADGSSGPSAGITQNQALSGQNLFKGMAFGLGPAAHYFDDLWQRPEIKAKLGDETLAKREEAAEAVIAKMSALDPAFFERFGNDLRSGNHLVIDQLLTDTRELTVAAANALRKDAGQAGEINAAALQQVEAGLYLYVETAVAVAIVLILILTQIDMTPVMEGPQSSQLQRDVWVDMLAKRFAAAE

SEQ ID NO: 16705 - protein, 119 aa, Myxococcus xanthus
MLPYLRTPDGQWTWGSDTPNFQLKNAFGINRAARAQGVELGLLLHDTATLPREDCKEAPSVCLERAPVAKTLRNTSPRPTYCGQLGIVFQRAVPWAWSRTNQGKPITMPSKVLRLDVEC

SEQ ID NO: 16706 - protein, 990 aa, Myxococcus xanthus
MTLELGSLVAASVAYLLVLFLVAYAAERGAIPARITQHPLVYALALGVYATSWSYFGSVGYAARHGFRYLGIYLGVTLACLLIPVLWRPLLRLSRELQLTSLADVLAFRYPGQSTGTAVTLFLLAGSLPYLALQVRAVVESARVLSPSASPTLVGLGFCAVLTVFSVLFGARHLTPRERHEGLMLAIAFESAVKLVALVAVGVWAVSNVFGGVDGLLAWVDAHPEAIDALQRPARDASWAPLLVLSCAAAFLTPRSYHVAFTEAPEREGLATATWAFPLLLLVMNLVVPVVLWSGEALGLPWPADFHVLAVPASRGATWLALGAFLGGVSAASAMVIVTTLALAPMCLTHLVLPLGYARGQPHLYGWLLWARRLFIGIIILAGYGFHWLLNIRGTGLVDLGLVSFVAVAQFIPGVLGLLFWKRGTRAGLLTGLAVGASLWLLTLVVPLWASPGVVAWTHRMAALLGFSDSEPWGFATFASLTLNGLAFIGVSLATRQSAEEAEAARACTREEAAPAAGGVVAGSPDEFRRKLAPLLGEEAATAEVDRALNSLSLPQDERRPSELRRLRDGVERNLSGLLGPVLARITVEEALRLEPGARTALAEQLRFVEERLRDARGLQGPVPALEAVRRYLRRILEDLPVGVCAVGPDGEVVIWNATLEQLSGVPVDTVRGHPLDALPAPWGPLLSGFASGVDGDTETRVTVAGVERILRLHRSRLSPAEQGTGSSEGMALLVEDFTARKAVDARMAHQDRLASLGRVAAGVAHEIGNPLTAIASLTQNLKYELEDPAAVQERAGLILQQCRRIDAIVRTLVGFSHEGTVGGQARPFTRVAVAPLLSEAVQLARLARKQHGVSFEHRCPEGLEVQGDAQRLEQVLVNLLTNAMDASPEHGVVELEADIDGSAVRLRVMDRGHGIPTELAQRVFEPFFTTKGPGEGTGLGLALAAGIVREHGGTMQVDKRQGGGTSIVVSLPEPRRMEASVNPEREAPA

SEQ ID NO: 16707 - protein, 221 aa, Myxococcus xanthus
MPWSASLTDGGDQIAAILALLMLPLALTDDRRWHWDTPRESTGNDEAKRLIARSAWVMLRLQVAGIYFHASVGKFKVTEWVDGTALYYWLLDPSVGAPDWLAGVMLPVLSSPVVALLTWSVLLLELGLALGPLLNPSLRRVLLPLGISFHLGIAVFHGLISFVLVMCGALILLLRPFDELFRFEGLRAWVRHMRTPPVPTATPSLEPVAVQVASVPPTDGA

SEQ ID NO: 16708 - protein, 361 aa, Myxococcus xanthus
MDIHLAEEIRKQVEEAFRKRGRVNIVIAGRSGVGKSTLVNAVFHGRIADTGQGRPVTKETREYTKDDIPVSILDTRGLELGAFQETLKLLEELVAARAKDADATRHLHCAWLCISEDSRRVEDGDVKAVEMLARHMPVVVVVTKARSDQGFRAEVQKLLPMARNVMRVRALQETDDEGHTLQPKGLVELVELTMELVPEAQRNAFAAAQRVSISQKRKRAHGIVASAAAAAGLIGAVPIPFADAALLVPTQVGMLAGVSSVFGLPLTEAFLSTLVGAGITGLGATFTGQSIVSGLLKLVPGPGTVIGALISATTATALTTLFGEAYVAVLSKLMEKRCGELPTEEEVIQAFREEMSLRGAA

SEQ ID NO: 16709 - protein, 276 aa, Myxococcus xanthus
MELQQAPLTAPTATVRFLNGWTHSQHGAIVRGGTLVVDYDLYRMTDCHHSTYAGQQAWDTLAYVRFLPSGQLFSGSVKQATGSTSFVNKPFEVTVPSDATSVETWFFTSGRTCAPKYDSNYGQNYVFPVEAQSPSAVVWAGDWGGSFARDCEHRDGLADPIVIDSYVMERACKFVDADVYVPGVTDAATARPELIQAQVEFSVDGAATQHRWLAYQGRVGNNYRYRWNLAAEPLAYTPWNAYAFGFRYSTDGVSWYRIASGAGPTGGTARTVQRHF

SEQ ID NO: 16710 - protein, 500 aa, Myxococcus xanthus
MTEGTPRVAERISTGIPGLDTVLHGGFRKARTYMLMGLPGSGKTIFANQVCFHHAKRHGGRVLYLTLLAESHTELVGNLSSLSYFDPTLLPNAITYLSAFTVLEQGGLDALAELIRKETKNHQATLLVLDGLVAAEEVAPSQQAIKKFIHGLQVVTGLMGCTTLILTTGRGQGLRAEHTMVDGLILLRQRMFGARAVRELFVRKFRGSPYLLGKHSFDITQDGIIIYPRLETLAESGPPPGPPQDAKCAFGIPGMDAMLTGGMAQGSTTILLGPSGSGKTLLGLNFLAEGARRGERVHFFAFYDSPERMVAQAAGIGLDLKPLIDRGDFEVSFRPPTENLLDKLGVQLLDIIRTRGARRLFLDGYDALRRAAVRQSRVSRFLAALVNECRMRGVTLLYSVESVSAFGPEVTFPMRGISMVAENILFLRQAELDSRLRRFITVLKLRNSPHDTSLRELCISTKGMEVKGAFTDVEAMMTGVPRSTTWSEPRHPPGGGRQEP

SEQ ID NO: 16711 - protein, 121 aa, Myxococcus xanthus
MGPILIVDDEFGIVEAMRDLLSDEGYRTAIALNGKEALERMAEEHPCLVLLDYMMPVMNGPALLEAMERNPLLRDIPVVMMSASPPDYWKHLRCAAFLPKPFSLDELLVMVKRFAQGAILQ

SEQ ID NO: 16712 - protein, 354 aa, Myxococcus xanthus
MVGFPGTHIDSELAALMDDGIYGAILFKRNVGSAADTAALCHALKTRAGRPFILSVDQEGGRVARLRGAPFTALPPMRELGQRGDAAQVERVGRLLAYELRALGFDWDFAPVLDVDTNPANPVIGDRSFSREAEEVARLGVALARGLEAGGVASCGKHFPGHGDTTTDSHLTLPRLPHDLERLRSVELVPFRAFAQAGLASLMTAHVLFDALDPGVPATMSQRVLQGVLREELGFDGVLVSDDLEMKAIAGHYSVEEATVQGTLAGVDLFLVCHNADVQRRAIEALVKAVESGRVSRERIAQAHRRLDALSARFAHPAEDRLALLGSPEHHALAEGLVSTFTGRDPTEVMLASR

SEQ ID NO: 16713 - protein, 180 aa, Myxococcus xanthus
MADCLLEDAWADVLPARYFLEAFFAAADFFATADFFAGAGFFPAEAFFAAAGFFPAEAFFAAAGFFATGAFFAVAAFFAARGALAAGADFFAVAFLVAADFPETVLPAGAFFAAATFFPAGAFFAADFFTAPPAAGASPFSTASTSATWPFTFTLGHTCFSTPSGPMRNVARVMPRNLRP

SEQ ID NO: 16714 - protein, 248 aa, Myxococcus xanthus
MTADSRRVIILMKGRFSSPAGLPIEARLGCRVVQPILLAFLLGLSQGMLHAVGPDHCAAMATLGTLGGGRRRAAIATTVRFAMGHAVHAGRHRPGSAFLGGVGLSETFERWAEIFGGAVLVALAVAALLFPSSLDHGHPHLPGHTQEPHQHVHTVSTTAGALMAVSGVRSLLLALPPLLVGGSMSAAAWMYLPGFALGILIGMGVVGLIFAEGIARLNAQITRWVQRVVAVGSGALGLFWIGSRLVGG

SEQ ID NO: 16715 - protein, 303 aa, Myxococcus xanthus
MGFREDMERILGAMPPRRQTVLFSATFPPDIEALSRDFQRQPVRVTVEAATAGPDIQQVRYDCEPGDKQALLLRILRHYQPASAIVFCNLKATVVELKKSLSASGVSVDGLQGDLEQFERDRVMAKFRNQSTRVLIATDVAGRGIDVEALDAVINFDLPMQAEPYVHRIGRTGRAGRAGLAVSIVTPRDGRKVDDIQLATGVKLERGDVESLPSADPRNAVSLESTWDTLYISAGRKDKMRPGDILGALTGEAGGLEATDVGKIEIQDHVAYVAVARRVSRVAFQRLSEGRIKGRRYKIERVK

SEQ ID NO: 16716 - protein, 110 aa, Myxococcus xanthus
MKNIEGGNTNKPLPPWTLPANRGYNGTIDQIGSSIDPRTPKNDGTQGRSIVDDAGKMMNDRYHVEGGAAYSPAAHGLGGEDGATLGGKRGGHHSGYSPLGWQDRSGPYRR

SEQ ID NO: 16717 - protein, 53 aa, Myxococcus xanthus
MPSLLVFAVAVLLFGSPLRRLWLAEGAPGYLPFAVWLGVILLGGWAAHRSRGP

SEQ ID NO: 16718 - protein, 274 aa, Myxococcus xanthus
MPMPQAGDQAPAFQLADQDGNAVSLAQFAGRSVVLYFYPKDDTPGCTVEACGFRDEHSALEAAGAVVLGVSADSTASHRKFATKFNLPFPLLADVDHTLSEAYGVWGEKSLYGRKFLGITRATFLIGPDGVLKQVWPKVKVNGHVAEVLAVLKGEAPAAGGAVKKSAAKKAPAGKKVAAAKKAPAGKTVSGKSAATRKATAKKSAPAAKAPRAAKKAATAKKAPVAKKPAAAKKASAGKKPAAAKKASAGKKPAPAKKSAVAKKSAAAKKASRK

SEQ ID NO: 16719 - protein, 157 aa, Myxococcus xanthus
MPLALCLLLSPGCDKGPDQLRDAEKSYRDLIDRRVSPLDPAWDPVINAFEAIPKDSKVRPEAEQRIAAIRRLRGKLPPRPLATPGATGPGTSEVDTKRAACEALAIRLGQTPEGADREPLHQALTDCQKELVRLEAHSHPPGEHGHDHGGEPGHPAH

SEQ ID NO: 16720 - protein, 207 aa, Myxococcus xanthus
  unsure (1)..(207): unsure at all Xaa locations
LGVQKGKVKKVVYFEKGTPVFALSNLLADRFGQFLVRVGKIKPEQLQXASAVAAQSNRRTGDVLVERGLLKDTERLYYVGQQVKAVIYSLFAWDEGTYVLSFREKASAESIKLDVHPANLIVRGIKKLYKPERLRRLLQPEDRLIPAVAPAYQLNEVELERWEAELLPKIDGNRTVAELLAFANRPEHVVYGFLVAMMSLGILDKRG

SEQ ID NO: 16721 - protein, 254 aa, Myxococcus xanthus
MSARAYGMGGAYRALGLGTDAIMGNPAAMVLYPSYRVEGTGAWDTRRKEGLLGVSVVDAATSRLGMGVDYHWVSVGRGGARASAHLSSMGVGMPISQALMLGATVRYLRMSGQSRFANSVTGDAGLILRLSPSLMAGFSAHNIVDTGNEELTRYYSAHVGVMTGLLTLAGDVRADFTTNDTKTFTYHGGLEYILGELFPVRMGYSYDGFTRTSQISTGLGFMSEGGGGLDFGYRHDLGGPKGRMLALTIKLNMN

SEQ ID NO: 16722 - protein, 463 aa, Myxococcus xanthus
GAPVLLVHDDIANIAAVRRLLTREGYEVILATSAADALIAYGHHLPVLLVLAPGVESGRGHLVLEELLQHPDGKSARVLLLGESIPGFSAPVAQLPLEGAAFVELVDSLVNAPADADAWHVVENRELPPSGGGSAATGAETESWHATPPPSVAGDSALANALFGDLAPLHQTDWELAAMTDAERSAHEAAQKRERQSTRDLDTAMERAHLEVEAQAMASIDSALAPDSSDGWGEPSQGQDWGSAVDAETAGDDAQGASAGLEGEDAAPAEDAPPVGQLAWTEEAVSQPSMRTAALAPRLGDEGFFDVDTPEAPAGDALSAAEAELAAMRGGPSFDSVSTEGSPWTELPPDPEMEHAGRVGSGGDGAGDVPGEAPSTEPKLAADAEPQSPSSETEDTWGTEAALGEPADTPEPDAAAVSASNWELLEAELQSASGPSQDYEEPQASGVGDDWFDGESTETPKEE

SEQ ID NO: 16723 - protein, 354 aa, Myxococcus xanthus
MPTIELVDLRVERPREGVVTEEAPILSPPLLEAMAETIGRGQQVILFLNRRGHSTVLLCEVCGLSLKCSECDVCLTHHRSQNRVVCHYCGLAMPVPEQCLECTGPMLKLGIGTERVEAEVLERIPTARVARLDRDSASSAERLTEMLASFARRELDVLVGTQMVAKGHDFPGVTLVCVVMADTSLSIPDFRAAERTFHLLTQVSGRAGRGKDPGRVLVQTYNPDAEPVRRVLAHDFDGFANQELEWRKALAYPPYSRMAAVRLEGEHPEQTASVARSLGNIVSRHMPPASAGVRMLGPALAPISRIRGKTRWQLLLKGPTHTALAPLLARLEAALVDVPSAVKVVIDVDPGAML

SEQ ID NO: 16724 - protein, 201 aa, Myxococcus xanthus
MSTATRSVLTTLAEKGQEAELVVVDLTKGEQKSPAYMEHHPFGVIPAFEDDDGFKLYESRAIIRYLDRKLPGPSLTPSDVHAYARMEQFISVEQCYFSPSAMKVIWERLFKKVMGGGTPDEARISEGLQGVERVFGIIEPVLGKQQYLAGDGFSLAEVTWMPYMDFFVAAGGAELVGKYPNVAAWWERVRSRPSWKKVTGA

SEQ ID NO: 16725 - protein, 135 aa, Myxococcus xanthus
MSALVSQVCPLLATGSGNVQELKEAVIRHLQGLGIDTGRTGLARFGGEVAYVIGDMAEGRPQFWVYKDSFRPARVRYSDASGTAWDVRFLDYNSPATGEWLPRTIEVWRGGQRNLRFTALKGDNRASLPDSLFTL

SEQ ID NO: 16726 - protein, 133 aa, Myxococcus xanthus
MEVPESETHMYGIAAGTDLGDGVMRIDRIVEKPKKGTAPSNLAVIGRYVLPPDIFPILENQTPGVGGEIQLTDGLATLQQSKGLLGYRFKGQRYDAGDKVGYLKANIAYALKRPDLRAGLLEYMREVVKTEKP

SEQ ID NO: 16727 - protein, 1444 aa, Myxococcus xanthus
  unsure (1)..(1444): unsure at all Xaa locations
ARQLREGSAARAFGELARASRTLPMTPRLAAGIVRMALLAGTEAAAITLLEVAPTVVSSRRAVRRQLARVLRRVDQLPRAAAALEALLVEWPEDRRARRVLQVLRARIGGKAVPDAGASAPKVDEDEEGVLAKLPARREGAQAAASWENDDAVYLIETVVGPPLSARAVSASASTVGAVEARSRSSVSQFPAVGGGAPAAVSPARGADGLQAEAPPVSEQRGPVSISVPPPGADVSATASSKGGEALPDTDARPPPVKAPPTESLKTVLEMPAVELPAVTPRGTSASEAPRTVVEMPAVVVPPGASDFEARKTEVEMPALGDVAMPPSSGVAKTFVPGRAPLPVPWADAPDDDAVAPAPVARFDDADESEVTSEAQPFLVGADVSSPPPRQQTPASSKSERRKTPPPSEALPPRITSSAAPEPDARSGTMEVSLAELEAALASASGDASNKKGRASEASAGPREEDTEELTRSQKVEAQLIARRAWAELAQLYLKRADRAKDASLRADALARLAEVMENELHDPAGAARMYREIVELTGDRAALRDQVRLLAARGDASLVRRALDEAIRRAPAGRARAGALLTRGERWLHMGELKKARADFEAAESSAPGLLPVLAGMLRCVSDAERPSIAERLRVALAAAPRRALDRVEALRVLAQVAEESLSDWRLAQWAWSEVLTESPDSEQARVQLTTLTRKLGDTTVLSRLLRAQLARESRGPAARQARLELVATLDAQGDADAALEELRQAVRYEPGHKEAWLMLVERLLARDLLGEAAWALEHAATAMDDEAERERTWDRLARLWREVMGNPERAQVYARRAEGIRQARAEREVPPPEPPRSAAPRRESSGPRAPLIAAPPVLTQSSGNLQSLANEDASTTDIGVAPSASESVEPTRDEVGRNAPGAAVEQGRKASPEPVPSSGRKGRREARSDADAPLPKGAARATVSPAQGEPRVPSEAFAASPPKAEARAAASSPRGEARNPPSSPGNTAAPPPRAPAESADAAVAPKAPAAQRAPAPSRGDKAAPRAAXXGSEVEQGPASRDAEARAQRPRATDLITGEVMDLGDAPVPETRVISWEAPPGRMDPVRRVVRARPEGTVSAPAPGRTFIAKPPAAPEPPRPVPGVTDPRESPAPAYVPSPDTEPDAFRHIRERPLDAKPYRLLAEYFDQRGDPARASLMREIANALDGLETPAPRGQRPPLTSDERAGLRHPGLRTPSGELLACTGIALCRLFPAEGRAAGSSELMRATAGPCAPAVLDALHTAARMLDVHLPELVLAEDDGPPFTAVHAGHPRLLVGRLLLREPMPLPELRFHVGRALLSLSPDLLALRALKGGQLLRALALLATVLKDPRASGAEARVVRESLSPRALERAMALLEPGTQNFKASALADAARDSANRAGLVACGSIGPALSVLRTRRGNEAELVELLRFAASERYLPLRAPR

SEQ ID NO: 16728 - protein, 173 aa, Myxococcus xanthus
MSEAEQQRFTLFWQAHSPFSQWHPSDFTVDGVRYVCAEQYMMAGKARLFGDNEALASILSSKSPKTHKALGRKVRDFDNTRWEKARERIVYEGNRAKFTQSPELLKALLATAGTELVEASPVDRIWGVGLDEEDPRILHPAKWRGLNLLGKVLTKLREDLLAEGVTEASSAES

SEQ ID NO: 16729 - protein, 246 aa, Myxococcus xanthus
MSRAEYRDYKKAKADPCASSEPRWLADELTTVNSTMARFLRETEQLSKLDAPDHARQLAMMREATGSLPPIMEVHRYTLNRLKECGFRNTGAFPEIARRGQELLTEVDVRLEEGPKVLAAVALKDARRQWREEMPEREEAARRTWCPPNPQVGQTDLFYARQEVDGRKLWRFCDGHLVEQRAEGEPVLVQPDNLSWRMRRRIKPQSYLDAARAYPTAEMDRQPDSVPSSGQGAAKKSSAPSDGGPG

SEQ ID NO: 16730 - protein, 1117 aa, Myxococcus xanthus
RRVQLPLHVRCQQLHRTSYSTFQRPEPITHRQLQAADARALTAGSTCPRTPSWSGASRAKEAGRPAETSNAKWAAPHPSHRSGPGRGTPASPPGSCQWAGLALTYTQVADEAHRLAEELGARLAKAGWPERPVAVMLERSEAFFVVVLGILELGQAYLPIDPGLPPDRIRLLLRDSSCAVFVTRASLLAGPCPEGIELVDLDTQGPVAPPGRREERPPRGASPLAYCIYTSGSTGQPKAVGVTRDNLSNAVAVWRQDYGLVRPVVLQLANFAFDVSVGDLGRSLLIGGTLVIATDEERVSPERILSLIERHRVTFLETTPVVANAIRVHLEVMDQPPPPLDLLVVGSDTWRMGDLRALRRRLHASTRLVNSYGTTETTIDSSFFELDATASGSPMSDDAMAPIGRPMTHVEFLVVDPAGRMLGIGTPGELCIAGPSVSLGYLGRPDLTAERFVPHPRHPGERMYRTGDLGVLRGDGNVALLGRADQQVKVRGYRVELGEIERVLLQHPDVHAGVVLLLGSGAQATLVGCVIGVPEEALAGLESWLAARLPHYMVPTQWLAQESFPASANGKVDRRALQAAAAHARRARQAQVMPSTPLQQVLLEGWREVLPQVRSLSVTDSFFSLGGDSIQAIQLVLALRRRGLELSAAELFRHPTIESCGAYLETRQGQPARALDLAASEVDAVVRQRLLRPGDQELYPATAVQVLMLEAHAHHRPVDAVYLGYTVWEFEDERLELAILREALLRQLSRHGALRTTFTRDTDGRWYQRVRPVAAVELAELDLSDRPRSAQDADLDERAQRELARDILADVDAPACRILLVRRGPGACALLMTTHHAVDDGWGLTAFENALLQDYAALRRGVALPVPPPLPTGRQLVALEAERLRDERARAYWADILQRLPPPPYATRAPVPPSRSRFEGFSLTVPPATQARAAQRAQDAGSSLKALYLSALLHALAEEARTDTSSAWVVMNGRSERLDAALDAVGLFWSLVPVIGSNVGTPRTRLKAMDEQLRQAELHGAWFFPDLFGDCLGAGFPVCFNFTHFWNEQPSPEGVRVAARHMHNVWHFPLTVTLSLNSTSGTATLHVMHDATSLSRPHIDALLERVLQALADRESSP

SEQ ID NO: 16731 - protein, 217 aa, Myxococcus xanthus
MERFGQRLAELHLASMRFQTRLPRMAIDRKRLVDTPLERITGLLQELRLEPELARLQALAEPIRRRLDSFPSDEASHGFIHGDCNGENHHLTPDGQVVFFDMDLSGPGWFAYDPAVLLWTMRRAGVPAPDIVESGARCIAGYQRVRPLASWELEALDDLVLARHFWVMGEHIVDIPSLGALRVGPSYWRLAITRILEWQQTPLVPLIRERLSREGAP

SEQ ID NO: 16732 - protein, 375 aa, Myxococcus xanthus
MNDPVNTEATAHQTEAFRREGYVVIEQALSDDFLDVLRADFEQALHAKVARFDLKPAPRDARCEANDGVLNDFQPDGGNHDFNRWNMHLPSRRPYFEAMLVDNPRITGVIDQLLGPDWVYYIIASDTPFPNAGFQTAHQDYTRFSIAINIPLVDVTPDNGPMEVWPGTHQPPSEGRLAPFTTGAHRIDEPTLKSLVRRIPSRKLVMRRGAVLIRDHRMVHRGTPNLADAPRYMLSLYCIAAEQVPYRLLSDAGATLALSLRRMGRGSGAAVRHRRLFDLGAVLGRVVEECSLSDRDYRRTFSAELWASLGPRARHHLRFARVQGEDRVRGQGDLKGSGAFLKRYAQSISEALQRPDGRPRLPDHYAEGRPGTDAP

SEQ ID NO: 16733 - protein, 331 aa, Myxococcus xanthus
MGAQAYGEVDQDFVRSVDVEALGERLYDFTDKVPWRGRVPIETPDFFQFDNPSFRDWLSTVHALLAAHTQAHFARFARPDMAIAYAGGCAQNVVINQELFLRYPRLVVPPHGYDGGLSLGCLELLRIQLGLPRFSTEGFPYWQEDDCEDAPTESTIAQAVELLAQGKIVGWFQGRGEVGPRALGNRSIFMDPRQHDGKDRLNFRVKHRETWRPYGATVLLERTPEWFDLAEESRYMLRSVPTRPERQREIPAIVHQDGTCRVQTVGRDAPTSARRLVERFQQHTGLPMLLNTSLNAGGSPIFATRAQCRDFFAAVDMDALFMGNEVLVRQG

SEQ ID NO: 16734 - protein, 466 aa, Myxococcus xanthus
MRLTLIGHASLLIETADCRVLMDPVLWDPHQEGLFHVHPAREVLHARLPPLDVLVISHRHLDHFDIRSLAHLPRQVQVVVPQDPLLEKSLRALGFEEVHALAPLTEFFVGGTRFVTTPSRAPVREFGLVIQDETGTCFNAVDTVLDASAVAAVRQVAPTLDVFLASWQPMLEVDFQWNRPVAFPVQRYAELLGHVAALEPRAVVPGANGFRYCGISSWLNQVVFPVSRARFCVDVKRARGDCAVFPMDPGDVLEFGAAGFRLDAGGASFVRRLPEARVSLDYRPVDFDGRLVDGPCAPDEAAAIRASVERVMDVELPRFLEEADATCWRLHQQHGVVQQLEVVFPDERLSWCIDFTASPPRMARGASSLATVHSLVTASVLHGIASGTRTWDYAIMGGFYRRFLTFEPQAPLSDPLRLRFPSGQAQASVIEAEVARWAGVRPLSSARAPRALLQRCGVFPTGATAR

SEQ ID NO: 16735 - protein, 569 aa, Myxococcus xanthus
MQVGYVALVGVLTDSLLSPHRVMLFGRRLPIGRLGLGKVAAGLVALIAGCSFFEYVSRILWMRAAHRITHDLRLRLYEHVQSLELKAFADTSRGNYLTLLNEDLNRIELLFSSTWGVWNEVAYATCSTVGFFLVSPGFAGLAAVPMPALLLLAQSLEKRIRPRYAALRQQAGVLQGVLNNNIDGIPTIRAFGAERMAARWVDEASVGFRGEQDAATQIHSSYNPVVLAAANTLRMVTALAAGFHASRGHLTPGTYVSLVILSTSLSLPMLSVARDFPHILSTLASLSRVFKAFELPRERRDEGAALDAGAVRGAIRVEDVRFGYHPGLPVLDGFSVDIPAGKMTAFVGETGSGKSTLAKLLLRFHDADAGHILLDEQDIAGLRRGDVRRAIAYVGQDIFLFNGSIRDNIAFGMPDVGLEAIQEAAQRAGAHEFIMQLPQGYASHTGELGQKLSGGQRQRIGIARALLLRRPILILDEVTSSLDAVTEAQLLRAWSEVLAGRTVIVVAHRLSAVRDAHRIHVLERGRIAESGSHEELLGRGGRYARYWDLQVNQKELPPDAFPGRGGLPS

SEQ ID NO: 16736 - protein, 585 aa, Myxococcus xanthus
MSGAWEGKLYDVIVMGGGPAGATLAARLRKDPGLSVAIFESERFPREHIGESFVPSAVSSLQESGALGRVLSSDCWIKKGGGYYSWDAVRPWSTFFEHKAYERDGYRRWAFHANRAELDDILLRHAEENGAEVFEGTPVKQVYRRDGFTEVDLGEKGSARCKVFVNASGRYSVTSLGGPREFLSSYRNIAIWSYIRKGKPAQSLPGDWNIFRESGVSPIGSFAFEDGWFWYIPIPLEVDGRREVVHSLGLVTDPRGLKSKRDYMSPSVFMETARKVPFLCDLVADAELIYDEFRTTANYSRISHQMCSWENREIRVGDAAFFVDPLFSTGVHFALHHTAAAAVLVRAAFDEAMPEQHREDLWHDYDQMLRKQAQVFSLAIDQWYNEISLAHPGSVYWRERSERATFEVRNATFHYLVNGSLDEDLLHVISQGNDAVEALSETGAWRTSFAQLQRLRPADDALVQLMPNVKFRQSVTLEHPIADSAEDKLDARPQAFDHGPYWESPERHAHEVAPRFGRPSPCLRFYFEDGDHQDTVRILWNRPNSALLERLSQPHAYGPLLAGCSLSERGLLDQLLLKGMMRVIP

SEQ ID NO: 16737 - protein, 43 aa, Myxococcus xanthus
MADVAPVAREVLEALPHLAPLRVDFTAELTTALTTLLRGLESR

SEQ ID NO: 16738 - protein, 111 aa, Myxococcus xanthus
MLENFGVTEANWREGAAKDPHFIASESPCYVGRAVAALAADPNVGAKAGRVFSSWALAREYGFTDADGSQPHWGDYFARAFGRPYQVADEDAYTSWRDGPMEIASPDWPLG

SEQ ID NO: 16739 - protein, 38 aa, Myxococcus xanthus
MPAGDHDALAATLREIAEEVRALRLSLNSGATREKQDV

SEQ ID NO: 16740 - protein, 255 aa, Myxococcus xanthus
MSDAAPAWLLRLLKVPPAPHIPEGAAVRVFRAAPTHRQLQLLRWGLRQAGVVVGLIFTWVAMKNRFVPHLPYAHADTVFFVFEMFAWLAFAAQAPITFLVAWLDYEYRWYILSDRSLRIREGLVSIQEKTMTFANIQQVSIRQNPLQRLFGIADVKVETAGGGSKRGAQDADASHTEGLHEAHFRGVDNPEEIRDVIMARVRMHRDAGLGEPQNPEPALPAPVAPSAATLGAAKELLGEMRALRSALTAQGHVER

SEQ ID NO: 16741 - protein, 152 aa, Myxococcus xanthus
MLRHGGYKPTGRGKPASEYLVRASGDGSLGAINLAVDACNAVSLHSGLPISVVDLDRATAPFRVGVAPEGAQYVFNASGQSIDLAGLLCLFDAEGPCANAVKDAQRTKTNADTRRTLTVLWGAKALGERTARAFDWYRELLERAGATVERLP

SEQ ID NO: 16742 - protein, 163 aa, Myxococcus xanthus
MEHVRYRYGFTERLSGEVFLQHEFDKFRRIQFRALLGAGPRVRVLTDKQATLVVGLALMLEHERIRRDSEPDAGEFRTDPRLSSYVLGRLEFMENVFLVQTLYAQPRVTNPADIRLLNDTIFEVKPNERLSVGIGFNLTFDNSPPLGVPKLDTQLRTSVGIRL

SEQ ID NO: 16743 - protein, 112 aa, Myxococcus xanthus
MTELYVEREDTVAKAVTLFPKDTVVRALSLMQRYGLSRLPVVDDVHGELIGDVTADDLTRVWQHAPLACMSEILSLKSLRVEDLEDATRWGPRLTLVSPLVDVYQTSKRWVQ

SEQ ID NO: 16744 - protein, 204 aa, Myxococcus xanthus
RPIEAELLSGSALYREVVLEKLLHARESVWMATANVKAMFVEHGGRFVPLVDVLDTLAARGVALRLLHAELPSRPFRAAFDRQARLVAGGLSLKVCPRVHFKAVVVDGAWAYLGSANLTGAGLGAKGDSARNFELGFVTEDFDVIDRVTALYEAVWSGAECKSCKLRAVCPDPILPAGKRAPTPRRPRADAPRLGKARRLQRGT

SEQ ID NO: 16745 - protein, 540 aa, Myxococcus xanthus
MIRLDNISKQNGQQILFIEASAALHKGEKVGLVGPNGAGKTTLFRMITSQEHPDEGQVAVDRGVTIGYFSQDVGEMEGRSAAAEVMDGAGPVSTVAAELKELEAAMADPDQADNMDKLVERYGLVQGRFEELGGYALEGRAREILAGLGFTQEMMDGDVGALSGGWKMRVALARILLMRPDAMLLDEPSNHLDIESLIWLEEFLKNYDGALLMTSHDREFMNRIVNKVVEIDGGSLSTYTGNYEFYEQQRAMNEKQQQAQFERQQAMLAKELKFIERFKARASHAAQVQSRVKKLEKIERVEPPKRRQTVLFEFQPAPRSGDDVVSLKGVHKAYGSRTIYEGLDFLVRRTERWAVMGVNGAGKSTLLKLVTGSTQPDTGNVALGGSVKMGYFAQHAMDLLDGERTVFQALEDAFPRAGQGSLRALAGCFGFSGDEVEKKCRVLSGGEKARLVMAKMLFDPPNFLVLDEPTNHLDMATKEMLITALSRYEGTMLFVSHDRHFLAALSNRVLELTPEGIHQYGGGYTEYVARTGQEAPGLRS

SEQ ID NO: 16746 - protein, 566 aa, Myxococcus xanthus
  unsure (1)..(566): unsure at all Xaa locations
MKKLVNAPRAVVREMLEGLVSLAPGQVLLDGESVVLRADTPSDVRARKVAVISGGGSGHEPAHAGYVGAGMLDAAVAGDVFTSPSTDAVLAAIRAVAGPAGALLVVKNYTGDRLNFGLAAELARAEGIPVETVVVADDVSLHDTVEPARRRGIAGTVLVHKVAGAAAEAGAALQDVLREATAAAEVLGTMGVALGPCTVPAAGKPGFTLEEDEIELGLGIHGEQGVRRVPMQTADSLVDTLLTTIVEDRRITSGDRVVLVVNGLGGTPPMELAIVARRALAALRQGGIRVERAWSGTFLSALEMPGCSLTLLKVDDARLARLDAAVDAPAWPGAGRLPKEPGVYRPSSTASPASLPAEAPQPGMDRFRKAALRVADAFEQSEPRLTALDSAAGDGDLGLSLVRGAEAIRALPEDAWTSPARALTAIGNALRRSIGGSSGPFYATALLRAARRLAEGPVDAAAWAEAFDLAVTAVSELGGARPGDRTMLDALRPAADAFAKAVRCGQGAREAWASAVHAXEAEEEATSRMQPRLGRASYLGARAVGVPDAGAAAVVVWMKALTPGIG

SEQ ID NO: 16747 - protein, 245 aa, Myxococcus xanthus
MPRHVGIIMDGNGRWAESRGLPRLEGHREATSSVREVTRTARRLGIQALTLYAFSSQNWARPAEEVAGLMDLLREYLERERSEILDNGIRLNAIGDVDRLPRYVRDPLDRLRADSAHNTGMVLSLALSYGGREEILHAARRLAEAVERGELAAGRLEESDFEQFLWTQGLPPLDLMVRTSGELRVSNFLLWQMAYAEMCFTDALWPDFRTDEFLRCVSQYQQRERRFGLTSAQVQREDAPQQAKA

SEQ ID NO: 16748 - protein, 182 aa, Myxococcus xanthus
MENPLGRSARQALVAGQSPFAIILSCSDSRAPSEYIFDQGLGDLFVIRVAGNVVAPSLVGSVEFAAAKFGTRLAVVMGHSHCGAIQATLDYLRDGKSEASENIRDIVERCREPVATVVSAAGPKADPEFLMKESVRANIRNSCDNLRHGSRLLERLCREEGMLIVGAEYSLETGAVDFFNGV

SEQ ID NO: 16749 - protein, 36 aa, Myxococcus xanthus
LESQMAAMELPSRALSVDVTRPPADIVKHIRDELGV

SEQ ID NO: 16750 - protein, 236 aa, Myxococcus xanthus
MAELQSFRADFRVRIGDLVYLTASAFADVRREEVVPGYAHQLGARAALRAAAADLRRSLQGRLERAAKAEARARPSLARQVAESLSAFVSLPASVALRTPQKHQVLELRARLLDTATQSELAPDALPELVEPYLTTLDEQMEEVTRTWLVVHDRAMWATCGMKLEQADMHLTLGSRGAERVLAEAVEAAGALQGRSAPFDAFLRKARQEAGDGLDEAGARELLGRFRERLAALPFS

SEQ ID NO: 16751 - protein, 174 aa, Myxococcus xanthus
MSEQLEALLSLTDAQAMFVPQPRTYSSQLTYGLDELISTVAKPPTHPLVESEVMANVKQSLEETLKIEGAFAACLADSKSGMCLGSVGGSPAFNIETAAAANTEVVRAKTKAMSMLGIKDRIEDILITLGEQYHLIRPLTGKEGLFLYVALHRASANLAMARYKLSEVEKSLQV

SEQ ID NO: 16752 - protein, 78 aa, Myxococcus xanthus
MSCPQPRPTEFRLPLRAESFSIDEHRNVHCRFYGGCIDVAVKKDWDSFTCAKCPLFHEDQAPGASAYAFNQPADPGRP

SEQ ID NO: 16753 - protein, 212 aa, Myxococcus xanthus
LRQLLLSDFRSEGPAAGHGWPLVQHTFPTVQLAPLAAGRGGRVLHLDASEWNAPAFDPIAWDARVFEAAESTEWLSLHLDGASCEALVVAALEILTRYQCLVRRRNAASATPLFSRLLARYRSLHDLEQPRVRAEFHRAVDAWQWTLRLRPDVDLPPQAAAFFHEGEQPTTPLHAVRPVRVLEEARPDEVTCRRVRELLTRDARTTKRGGCP

SEQ ID NO: 16754 - protein, 753 aa, Myxococcus xanthus
MKALVTKGTAAVFLVDGEGKETPLPLSKGTEWTRTTDDRGLSARVVLPEVPDGDYQLRARVTSPLGTDTVDAPLPLYANALAHVLTDRPLYEPGHEVLFRAVVLRAKDLAPLDGRPGTWVVRDSTGEVVLEERAPAGPWGVVAGRFPLDRGAPQGSWTVSWVSGGAQASASFEVKPFTLPRFRVEARSARPFWRVDEVPVVDGQVTYASGAPVADIEVGLTWDIHGDWPAPTEWQAGGLPNRARTDAAGRFRLSLPRVPMDLRGQAQLVARLVARDAAGDRIEGGVSLLLSEDALQVSAVTEVEGGLAPGFNNRVYVRATTAAGQVLPGTELTVKRAWDPRDEGVRAMTDEDGVAVFQLDPGPPVNVVVPPMPVRPPLPEPTVRLGQTRNLLAPGREASLEDLLALEKALPALEPCARFVASEQGEIDVELGLRVSASGAVLDVATGASSLPTCVASVLRSRTLPAGRERVLHVGLSVMDPGLPELAVEVESAYGAPESLVAALADAARDARTCLPRDLGMEAPLSAALSWRLGKRGLESLTWVTLPKQSGSLAASALPCVQERFARVRLPESARTENALGVAYLTAHPSAGMEHQDVAQATTFLGYELKVSGTQGGEVVGETKLVLRPAEVPPTRLRATPVLARGGEEVRIELMRGPQFEGPLPGTLVLQAGNQRMEEKVDKATRSVRFKLPEDFEGWAMTYWEGAQGRVYVAPRAQLSVEVTPDKQRYSPGELARLQLQTRVDGQDFRAHW

SEQ ID NO: 16755 - protein, 97 aa, Myxococcus xanthus
MSDAPKPFLHRPNRQLITKEPDPAGRWSKQFPDMIGYASQGGGKVPADYGWNTNPKQWQEEMTSESLAARYGELRILPPKPESPALPEGAKAEGTKP

SEQ ID NO: 16756 - protein, 67 aa, Myxococcus xanthus
MGGVLRVELLHDRRGWGVEVETWAGAVRRYRYGSEAQARFFAAVFEMGPRVLPPVSTGRRKRTRRAA

SEQ ID NO: 16757 - protein, 63 aa, Myxococcus xanthus
MGGCNYTLSVTGEGYSGWRTCQPGTTLQPGPVSLSLPEEVLRLGQGERATLLALLLSETMLPP

SEQ ID NO: 16758 - protein, 202 aa, Myxococcus xanthus
MRDAARTGETAFWLTIVFAFFAWIYHLFKGPLAEAPTRTAHLVNGFLYGAVGLTAVSALRLLPDHGLAWVICALVITWANDTAAYFFGRFLGKHKLYPEVSPNKTWEGFFGGMLGSVGGMFIARQFFFPVFTVWDCVLLGIAGGILGPVGDLCESMLKRAYGVKDSGVLIPGHGGVLDRIDALLFNAPLVFVYVQFVRGLLP

SEQ ID NO: 16759 - protein, 266 aa, Myxococcus xanthus
MEVRRPVAELGARAYAIQLLSDARIPFLVGGAYAFAHYTGIYRDTKDLDLFIRKDDADRALEVLARNGWSTQSNVHGWLHKAFWDDFLVDLIFASGNGITVVDDGWFEHAVRARLLNCACNVPPAEEIYWSKAFVLERERFDGHELTHLLLKTGRTFDWPRLLARFDRYWEVLLAHLMFFRFAYPADRDIVPEWVMRELLSRANSSLAEGNWDSQLCRGRLLSQVSYQVDVDEWGYEDGRAWDESERRRECEPEAVPAASGTYGGH

SEQ ID NO: 16760 - protein, 290 aa, Myxococcus xanthus
MVLGVLARHSGKFPEGSAGAFNTFVLYVALPALVLRAMHQLVFVPELLVAASVPWLYYLGAGPFFRLLGPRLGLSKPSIMALVLTAGLGNTAFVGLPMAEALLGAKGLPVAVVVDQLGSFLVLSSLATVAAARAGADTPLSLRQLARKVATFPAFLALVVALATRPWAYPVWLDGVLERLGSLLTPLALFAIGLQLRLSGIKPRLPAVALGLSYKLLLVPALTAAGLLALPGLAPTVVQATLLQSAMGPMVSAAILAAEHDLDPDLAVLMVGVGVPLSFATAPLMLMLAR

SEQ ID NO: 16761 - protein, 494 aa, Myxococcus xanthus
MSQSKFVGALTGLALLAGCGGSDGTTPASEETLGQGMSWEEFLSLVYQEPDTGIFIADGDTTFATEKHLREFYDNNVKNGQLIVHRVGGADAKWNDTQKLNLTYCVSTTFGSNYQAVVNAMASATGAWEAAGHVKFVHVSAQDSNCTASNNNVLFDVRPINVNGQYIARAFFPGDARSSRNVLFDNSAFGPMGVWTLAGVTRHELGHVLGFRHEHTRPEAGGQCFEDSNWGVLTTYDSASVMHYPHCNGTQTGDLVLTTKDVQGIQALYGTPNGEPPPPPPPPPEGVPTTETRTGSVGANANVNYGPFTVVPRSTFKVVMTGTGSGDPDLYVRFGAAPTTTAYTCRPYLAGANETCELEVPEGETSAYIMVRGYSAASFSLTINYLAPLGGGSGTPTSETRSGSVTSGGSQNYGPFSVKAGTNFKVVMTGSGDPDLYVRFGAAPTTSAYNCRPYLAGASETCDIAVPAGQTTAYIMVRGYSSGTFNLAINYTKP

SEQ ID NO: 16762 - protein, 501 aa, Myxococcus xanthus
MKRLVRALELNADNVSARELLGATLDARVAAGNVALKAERLQDARTEFDAVLSVAPDHAAAKRGVDGVQVAWARRWFGTGEGLEKAGKLGNALVAYVRADQERVGATAARERAEAVRQKLRDEVAFLVVASPVEDRAGAPDVAQRLAAGRLAARLPTQLPLRVVTEAPAGREGVTLDLSLERVLPLQVVEESQRTQRYLAGNRSVPNPRRSGFETQLLKAERTLEDVERKQAAALREYLRMQAELSMVRVAAERCRERERRQCREALQDCGEAAREVSGPGQFPSECNPSRCDNKACVAEEVLLVAKAAASLQKEKALEEALDKSEGQRTQVQRHRDATFREPITVEEPMYSDFVFDVQLHRLTVTASVTAVMRDLIKEQQVPAPNTQDYAVMHEDTAHKGYDRYGVLADPVQLRNELELRVEVGDKAVSDVARRVKERFDAYRGKRVEDARRGMVRPGAEDVVETAVRALLLTADAPPQDILQPLGRARGLNRPESLVGL

SEQ ID NO: 16763 - protein, 65 aa, Myxococcus xanthus
MDSLSLNKLKEGSLVIHDASFVRKLARCWARDLRHSKEITLENGGRTNPWRRLARRATQLVGQDR

SEQ ID NO: 16764 - protein, 1211 aa, Myxococcus xanthus
MNRDDETELWLAIDEGILSREEAAALLQDARRLGRSPLELLQERGRISEETLASLMRENLVLEERPSGEQPSPEQTVTVDPVRAEQALAPGDADVPAFPLLGRERYQPVRFLGQGGMGRVFLAWDPRLRRQVALKFVRDEESHTRRFVSEARAQAKVKHERVCQVYEVGHVGGKVFIAMQYIDGQSLGAQVRSLTIEQKALVMREAALGVHAAHRVGLIHRDIKPSNIMVESSDDGTPRPYVMDFGLAREWNESVTASGAVLGTPHYMAPEQARGEVSGLDRRADVYSLGATLYFLLTGEVPIPGANGLEVLNSIATEEPRAPRLLAPGLPADLEAIALKCLEKDRDARYDSARALADDLERFLGGEPVLARTSFAYSLRKRLRKHRLLTTVGAAALVTAGGALGWGIRARQEAAERERIVQRFTELVEGIESRGRYSALSRLHDIRQDRRALQAQMAELEAEIQRSGPQALGPGHHALGRGHLALGDEAKALEFLESSWRNGFRSPRAAYALALVSGRRYQQQLLEAQRIRVPALREAATREAERLYRDPALAWFKQSEGAQVPSREYVAALVAFYEGRFDDALLLADRAASELPWFHELPMLRGDVHAAQAFKRWNGGDPEGARASFEAGRKAYAAAIATAESDPAVYRSLALLENDAMVMELYGRGDVMPAYHRSLDALSRCLTIAPDDAQCVIRMARAHHRLAEHRLTHGGDGEEPLAKALEAARRALLVEPGLPAATFNLARSTWLQARYQIERGEDPRALLGEAAALFASIGVAHRDRAYHGDSGLVFTTWADYEEQIGRDSGGNRDKAILAYEAAIALDNRVPEDWINLGRAFFSRASRPLNAEAEQDLRRAAAALEEARALNPQHMALYFYAGQVDEQLARRRGRRGEDPRPVLAHGLEQYQRGIEINRRIPNFHNGMGVVHLLRAEDSWNRGEDPLPALEQARTCFEQAIAVAPGQGFAYANLGSLFVRRAHYLLALGESPLSSTHEAREALRQASERMPGAAWLLVLLGTVHVIQARVESDQGRDPGAAIARALKELHAALEVNSLEAEPWLQLGKAQALQAHWKAQRGSLQTESMEAAAKSFDRALTLSPDDPEYRLEAGRFYRRWAEHQNRTGRENGPLLLRGLEHAEQALKLRPDWAAARALRAGLKLEWVEAEPPGDPCTWRRQALDELTQALTHNSNLSNEWGGPLAGAQRLAACP

SEQ ID NO: 16765 - protein, 1607 aa, Myxococcus xanthus
  unsure (1)..(1607): unsure at all Xaa locations
MWFVGAFLILSSALYLVFESWVGMSSGFRSLTVFGLTASCSAGFTGWGAYLARREALRKPGYILGLIGTAVAPLAGIALGPMGLGDVFQLGGVGTVWLIPALLAWAAVAAFLARKPLEAFDSTSRPFIQLALVASTLMMGLAPLAAGQGGLALWLNVLPCALFFLLSSRPPPAPREGTALAFVLAAPLYLLLLYFARLHVALAGADVAVSVGTYAPFGAFLLATALRFRTLDAERGADSLSIGAVSLQATCLIAAALAPAPALFVTAAVISWTLLSLSRGGVARIRWVYAAYASTYLAYACFCQLIPGPVRRIINAVKAWFGYTTEPLPLQFGALSALPFILAGALFAVSRLWRGQRTGNARDLALAEVLLRATAVASPLFVFFGLSGPDARPSFWSALALAVLCLVLGLLVERFFLTVVGAGLSLFLPFQAYAVLGASGGAVASGALALVLAAVSMLCTARTRGLLGAVVGVVATVGFLMGLTAGDGFTAVTGMALCGAAAVLVAWVLQRASLMALASVLAAAALPRLAGELSPTAVAPTLAAVALGLSLLGMRGGLARWLGLPGVFYAMLAIPWGVLAQAPGLAGIILVSAGAVAVASRTFPVVRPLAVLMSALALVHDIPGLYSPWGGWMSPGLSVALFCCWALGASVAAARWGRGISATVAGLIALVFPLTALLGARSSEQAPLLLGAALAALLTARVLPAGLSVAVAALYALTATFSFGAVPLLCLAGVLSLLAVLEEVPAVLRVGAGGHRFALAATLSSVVVLGVAVVKWDDAGLPLLLVGTCVLPLLWARANRQPFFASLAVPYSFVGIVVVGGDVPSWVRALPLLSLALVRVVAHVPAAASLLLRSREEAPRQALSSWMQGWLAVVALPVLLVALRPYHVPTSLYVLLASLALMPGPRPVLRVCGSALALLFFLEARPIVIGLLLALAIAESHRPARVWAFFRSAPDTALRPGAVITALILATLPTLYSPTPSHLATLAGVLALAAFLLSQRWLLTPAIWALALAPMGAVRVNELFERGLDAGLSVIAVVLGAAVASAVFQSGRLQRALTQAFAKVLPPLEDTWSEPLWVGSAGALGALLLERLLLSGPGSLPLPVAVGAAVTACVLMVARERWMANVATALLGASLVAAVDPLWVPAVVSGTGLALCLIGSLVDARGVRVGASLHHGGWVLALLSLAGLRELEHVGTPLTFLFGVGAAWPVVXRRREREVVGWLASLAAVHGWLLYLGAVYSSGRGAAFILPYLGAASALLAALSLFVASKSRRRSVGHGFAGVALFEVMAGLALVDTSLGALREGLVASVALGVLLFALVRRAATEKEEASAYMAQVVLALGYLSVRMLGMGAHPGPGDSLAALVGGALFTGLYFFVQREGSSLACFRRPALLGAYLFPLAGLLSAPWSDPLHVAALMVGYAAHFAALATHPRHRGMASLTSVVAFNAALLLVWQGTGAGEAQFYVIPAGLSLLALLRVFREAIEVETYARLRALAVTAIYVAGAWKPLMFNDGGSMLLCVTLCVVGVACGIALRIRSYMYLGTAFLVTCIVANLVRFGMRDHRIAAASLFVLGLMVIGSMVMLSAHRAALLQRYARVRAMLATWEG

SEQ ID NO: 16766 - protein, 27 aa, Myxococcus xanthus
MSRSIVQRSLQLVGMRSLRRVSRGVPA

SEQ ID NO: 16767 - protein, 319 aa, Myxococcus xanthus
MDSVARVNRLYIDGMQVAQTTTPTALTPASLGTLANAWLGRSAYSADPFFKGSISEFRVHGAALSSNDLTASYQAGPDTVMAPGTEHVVIDGRTDVAGMAADTTSVYWVEKRTNGQVMKASLSTGRAQVLASGRENPSAVTTDATFVYWVEDDKAIFKMPVNGGSITSLASGLSGIGQLVTDGAELFWTQGGSILHMPVQGGTPAILYTTALAGPLAVDGHHLYWMQPGGTIVKAARPGGPASSLWNSSNATTGIASDGTDLFIAENLSPYDILRLPVGGSQWALAFAVRYGNITSLAVGPNRVAWFDPSLGAILAKGK

SEQ ID NO: 16768 - protein, 267 aa, Myxococcus xanthus
MLLRVLETGELYPVGASKPVATNIRLIAATDADLEAQIAEGRFRSPLLHRLAGYELRLAPLRERREDIAPLFLHFARQELDALGEAHHLTARDPHALPWMPSDLAAQLLLHPWPGNIRQLRNVARQLVIGSRGQSCLELDARLAQELRLDLAPPARPSASAVPPKREVAARRKSTDVGEQELLVALRAHDWDVKKAAHHLEIARSSIYDLIERSPSIRLAGDLSVEELTHAFHACQGNLDEMARRLEVSKRALNRRVKELGLYSKES

SEQ ID NO: 16769 - protein, 543 aa, Myxococcus xanthus
MLQNIGFFVILLGVLVTVHELGHFLVAKACGVKVLKFSIGFGPKLIGFTKGETEYQIALLPLGGYVKMAGDMPHEELSPEEASRGFLAQPPWKRGLIVLAGPAFNLIFPILVYFFVFLGPHQATSTYVGTVSEGMPAQAAGIRPGDRILSVDGEPVRTFNDMREAFVGRFERPVPIVLERNGQKLTLDVTPTKNVETSPIDTVERGSIGVEAVSKPPIVGVPPGSVAEQAGLRTFDRILAVNGVSVETEARFQQELDKHAEGTPLELTLRRMDSVAAGVVTGRVPSVLKLTVPKQPGVGLATVGAETSDLYLATVAPGSAAEKGGLRPGDRIIALDGEKPESFVKFSSKLNALKERSFQLTWRGADGERTETLAQAPLKTEDEMGTASSPIVLGVRNWVLSAADMPVLDEVTVHLGPGAALKQAALIVPKIVGQMVRVLGGLLVGSVPMNTVGGPIMMYQLASKSAEQGLDSFLHLMALISINLGVMNLLPIPVLDGFHLLSAAWEGIRRRPIPVRVREVANMVGLALLVLLMLLAVTNDITR

SEQ ID NO: 16770 - protein, 240 aa, Myxococcus xanthus
MPSRQAPTKPGRVVEPPPRPDKKPFDIDEVLGRIREAVRHFADAAMFALAARGHDTLFEQLVACILSIRTRDEVSLPVSLALLQRASTPEALARMSPEDIDALIQPVTFHEAKAWQLHAIATRTRDEFGGALPCDAQVLQSFKGVGPKCAHLALGIACGHEAISVDIHVHRVTNRWGYVQARTPEATMEALEAVLPRAWWVELNRLLVPFGKHVCTGTRPKCSTCPVLSFCRQVGVRDAR

SEQ ID NO: 16771 - protein, 142 aa, Myxococcus xanthus
MPEFGADGPGFAIHDPEVSAMSAAYARPRHVYFVVERAGRVIGGGGIAPLEGGDAGVCELRKMYFLPEARGLGQGERLLRRCLEFAREAGFQRCYLETLAGMQQAQKLYRRMGFEPLCAPMGSTGHFGCDHWYARDLSKPLD

SEQ ID NO: 16772 - protein, 339 aa, Myxococcus xanthus
DLVELFALQPRVSLEDYASPAAFAARHRALAAKVDALRARDASGQPRYPALAVWPESVGAPLLFLGHMHRVRQSTSLQGALKRVRLSEAWGVWNAWSDFRPPSLTECIYAARAPLVHRTLWNTFSGIARDFGLWVVAGSALLPAGRRGEGSPDFEPFSARTYNTSYTFSPEGNCVAAARKANLVPSWEDGLHLSPGRPEDLAVLQTPFGKLATLIGYDGFAQPHTRDEPWFAPCAQYLDAMRVDVLAHPAIHAGPWARSAQGERWRHEGLPAQLRTLRNVRYVVSAQQVGSLLGGTFEAASHILERTASGDVRVLAQAQTTQEEDVVHAIVPTAAHGTP

SEQ ID NO: 16773 - protein, 1021 aa, Myxococcus xanthus
MTAKKGRAEKAVLSRQEIATRRRALADKRMKAGKGGDVTTRAITGVFLLAASLIALLAVATFDAKDRVGPGFNNAVGPMGHLIAESLRGLLGVCAYLIPAGGIYTAMVLFVGSRDRKRGPQIISLALLTVSVSVLAQLMFAGDKGWAHPPGGALGASLGGIMSGLFSTVGTVILVTAISAAALIVGTQYTFLKLCSLAWAGLCVVGRRVQESASVFWEAQKVAYQERQERAAEEKLEEAAFLAQLEADEEELAEAERLAEEAEAAEAEAMAEEAFRLSKQQEKEQAIAAKLALKESREREKAEKLEKKLLPPTREADSLPPAPAPVLALPEKAPAKAEKRPALGADPAWAASFLPPSPNLIIPADGADATETPRARRRPNIVTGPAPVPMADMEAEPVAPVAAAPIAPVPPAPAAPADIVPAPPAALARMPLIVEPKAPPKPTVKKSQDQFEFVGDRKSFSLPPLDVLEYDKTERSALDKDVYLSTAEKLRAKLADFGIVGEVVEIRPGPVVTMYEFLPGPGIKVSKIAALADDLAMAMEAMRVRIVAPIPGKGVVGIEVPNRDRETVYLKEIAEQDAFNKGASKLTMCVGKDIEGMPYVLDLAKAPHLLIAGTTGSGKSVAVNSMIMSILLKATPEEVRFIMVDPKMLELSVYEGIPHLLLPVVTDPKKAALALRWAVEEMERRYQMLSEAGVRNIAGFNKLVESTAVEVKTTTESAPKKKAKPKNVLVLDGESPKSSMPAGGESLGVAAPRDDEDDMLDAQAPEEAEAPELEDESEDTEAMEASESTEPEKKQLKKLPYIVVIIDELADLMMVASREVETYVARLAQMARAAGIHLMVATQRPSTDVVTGVIKANFPTRVSFMLRSKPDSMTILGTVGAEALLGMGDMLIMPPTSAHLQRVHGAFVSENEIKKAVDHLKAQGKPVYDDSILKPRDEDVEGGGEEDELSDELYDQALATVSEMRAVSISMLQRKMRIGYNRAARMIERMERDGVVGAADGAKPREVLIRGLGDMPGAGAM

SEQ ID NO: 16774 - protein, 94 aa, Myxococcus xanthus
MIVAIARFRPAPEEADRLVARFQARTRAVDGYPGFLGLEELRSFERPPELMLVTRWRDKASMRAYFQSEDFQRAREASAQQEDATFALYEAVGT

SEQ ID NO: 16775 - protein, 378 aa, Myxococcus xanthus
MATLDEALMVALWSRIAMRVLYPLGAFEARGAEGLYEAAASIPWEEHLTPEHTFAVDATLKDSEHSHSGFVALKVKDAIVDRMRDTKGARPDVNTRDPDIRVVAHLARETLSLSLDLCGEPLHRRGYRVRPTPAPLKETLAAAVLRAANYTGTEGLVDPMCGSGTLLIEAGLIARRRAPGLNRDFAVERWPELGTRARELLADMRADARRNERKVEVPLLGFDKDPEALEAASRNVRAARLTEEIQLAEGDATRLPPLPETGGLIVTNPPYGDRLGTGGQKGMKSFYFKLGESLRVPGWRVWVICGNPAFESAFHARPSAKRDLWNGPIACSLLGYRPPDGGSARGDTGNGSEAPLGAPRQPEDVAPVRPQHEGEEEG

SEQ ID NO: 16776 - protein, 186 aa, Myxococcus xanthus
MNTLRTSLMLLVAVPLVAAAGDKSSAKAGKAAEADCHHPPAPQAQTAPKAEGAPDGWKLTRGEPLKGAKAVKLADVLAKPQAHDGKTVLLEGQVRKACERKGCWMELAANGQDKGPGVRVTFKDYGFFVPLDSAGAQARVEGVLKVAELTDSRAQHYESEGAIVPRGADGKPREVQLVATGVELRR

SEQ ID NO: 16777 - protein, 187 aa, Myxococcus xanthus
MRGVQSAADRAVQHARAWMLETEPGSRVHDVQLDPRFQHRGVDLLWELPSGEVRGIEVKGDRNATRRRYFFELVSNLEKDTPGCFLYSGADLLVYVFLSQGELHVVPMKAAREWFLPRAKEYPLKHAFTQTGAIRYTTVGAVVSVRDVAEGVPGVLRVPLKRRGGAKDVEEEVPPTSESPQGQESNG

SEQ ID NO: 16778 - protein, 479 aa, Myxococcus xanthus
MPVSDFQPVIGLEVHAQLLTQSKIFCGCSTAFGAEPNRNTCPVCLGMPGVLPVLNQRVAEFAVRTGLALECTIRPTSVWSRKNYFYPDLPKGYQITQFDQPICEHGRLVIDTPQGEKAIRILRIHMEEDAGKSVHDAGGGQSLVDLNRAGVPLLEIVSQPDLRDADEAVEYLKAMRDVLVYLGVNDGNLEEGSFRCDANVSVMPKGSTTFGQRCELKNLNSFRFLKQAIEYEIARQVDVIESGGKVVQETRLWDVNKGVTRSMRSKEEAHDYRYFPEPDLPPLHVSAEAIAAAAKALPELPRAKLQRFTSQYGLPAYDARILTAERPLADYFEACAGHYKDYKKLSNWFLGELMRLLKEEGTPLSALRFTPAQLGELLGAVDQGMVSANAGKDVLGEMFRTGKAPADIIAEKGLAQVSDTGAIEAVVDDILAKNAGEIEKYRAGKKQVFGFFVGQVMRAMKGKGNPALVNELLKKKLGD

SEQ ID NO: 16779 - protein, 486 aa, Myxococcus xanthus
MQLTDLTMLELAAKLAAGEASSEEATRASLARIQQVDPKVRAFLRVDEAGALAAARASDARRKSGSPASALDGVPLGLKDIFLTEGVETTAGSRILEGFVPPYDATVVRLLKEAGLPLVGKLNMDEFAMGSSNESSAFFPSHNPWDVSRTPGGSSGGSAAAVAAREVFGALGTDTGGSIRQPAALTNTVGLKPTYGRVSRFGVIAFASSLDQPGPMTRTVADAAALLQVIARPDAQDATSADAPVPDYSADLEAGVRGLKLGVPREYFTEGMDPEVEAAVREALREYERLGATLVDVSLPHTKYALATYYLIAPAEASSNLARYDGVRFGLRAKDARSLRDVYALTREQGFGAEVKRRIMLGTFALSSGYYDAHYLRAQKVRTLIREDFTRAFQQVDALLSPTSPVPAFKLGEKVEDPLSMYLMDIYTLPCNLAGLPGLSVPCGFTKAGLPVGLQILGRPFDEAGLLRIARAYEREHDFFRRSAPL

SEQ ID NO: 16780 - protein, 115 aa, Myxococcus xanthus
MPRSYLGEGLASFYGPGLHGRPTASGERFDQEAMTAAHRKLRFGSCLRVVNMENGRAVKVRVNDRGPFIDGRIVDLSKGAARKLDMLDKGVVRVRLYRCADRVSEIPQEMWAAPV

SEQ ID NO: 16781 - protein, 111 aa, Myxococcus xanthus
MADARTDKPSSTEEEYFAREEIEKKRKLALEQAAASAAQQREELKKLHWMKCPKCGMDLQTLKQGNVEIETCFNCHGIFLDAGELDQLVAQHGHEGSGKVMGAILNLFKKK

SEQ ID NO: 16782 - protein, 20 aa, Myxococcus xanthus
MLWTHRGNILRLARRTERRF

SEQ ID NO: 16783 - protein, 126 aa, Myxococcus xanthus
MGLAGVVGLLVARYIPVARIIPFWGCVLREQTGWPCLGCGLTRVADRVSHLNFAGAWEANPLGTVAAIVFALAAVVMVLHLVFAMPIPQVELSPREWSVLGVVTPIIILVNYAYVVVKTRFPHLLL

SEQ ID NO: 16784 - protein, 214 aa, Myxococcus xanthus
MADTLANLMQQLSFLLGGRQDAAVDAAFEKMNAVRAKMPLDEKGAPQERFMREALAPFTEKQAEIFDSLAEALASSGHVGHAESFADLEEFLLPDRRGISRAIVRAAKGELQPATEDMVKLTEDTERSPIARLLAVDGLIHIKAHGQAAAAARTLLAAAENGGDLHLALDLVPRLEHVYKAQNDRESLLELMGISERLEAAHDKIHPGHRRLRH

SEQ ID NO: 16785 - protein, 420 aa, Myxococcus xanthus
MLAFSVAYELELTGLFSMLELTGIPLLAEERQDGRYPLVVGGGPLTFSNPDPLEPFVDVLVQGEAEDLIHLLVEAAATMEREALLAHLARIPGFRVPGRGGARYHVAKATDSRLPARSQIVTPNTELRSMFLIEPERGCSRGCHYCVMRRTTNGGMRTVPPERILSLIPEHARRVGLVGAAVTDHPRIVELLRTIVESGREVGVSSLRADRLTQELVDQLRRGGATNLTVAADGPSQRLRDMVDRKHSEEQIVRAATFARTAGMKQLKVYNVVGLPTEEDADIDELIRFTSELSRILPVALGVAPFVAKRNTPLDGAPFMGIREVEGRLERLRKGLRGRAEVRPTSARWAWVEYMLAQCGPEAGLAAMDAWKAGGNFAAWKRAFDARECEPYLARRVEDGRRNPVLWPTVPRTAPPASAA

SEQ ID NO: 16786 - protein, 236 aa, Myxococcus xanthus
MTKNIVNTALVLVGAGSLLTGCNFEQPETNCFVQESPSWAVKYDVVDSPKDANGDECTTTAPLVELMGVYKYVNPETGAAQLALRPATLASRAIADTTTTSADQTSLGSLDTEPKDHGFCHANDFAPAFVNVAASDTAAANTIRYEFTNVRVYSAAVAPGTQFTGELKYTSNGCTSSYVMRAVWPPAPCDTASTEPAENCGVGSGLNPEFAVVCQPTSATGTTGYCVPAGDIPSFK

SEQ ID NO: 16787 - protein, 154 aa, Myxococcus xanthus
NALTASVGVSYRGSSGTPINYWGSHWAYLQDESFVLPRGAGGRTPWINTIDSNIGVNYRVSKDSVESFTLDVFNLFNFQGVNTVDQTYTLRDIKPIPGGTPADLENLPGRVEFQDQAPRDEPFGSVDGDVNKNFKNPLSYQAPRQVRFGIRYTF

SEQ ID NO: 16788 - protein, 469 aa, Myxococcus xanthus
PTCGNGTVDNGEQCDDGNTTAGDGCSGSCRVENGYTCSGAPSTCATTCGDGTRAGAEVCDDGNLNNGDGCSSRCLLEDGQPCNASGVCESGICNPNTNTCISPNVCGNGILDEGELCDDGDTTAGDGCSATCAIEDGFGCTGIPSVCAVTCGDGIKADSEACDDGNTTNGDGCSATCTVESGAACQTADVSVFITHQGNANCTQVSDIDAPVLPDAAIQAGLDVPGRYRIRYVSGAVSYSGGVNWYPGVIGVSANAGTQVQGFSLGYTPRSGPGSATRAEAMPLGFPLSRDFTAATGDVRIALVDTDCNLANNSDTAVTYRVDALSICQTAPVVTSPTPGGTAGEELEGTATPGATVDVYLDGNPAPVCTVVADAEGNWSCTLPTDLEEGPHTAVITSTFPGAPQTSTTVDFIVDYSPPAPPVITGPTPGAVLDTQTPVLSGTATPGDEVTVYEGGTALCTTTADAAGN

SEQ ID NO: 16789 - protein, 239 aa, Myxococcus xanthus
MAEGPHTVTATATPPGGNPGPTSTPVTFTITLTATEPPVITGPADGAVLNTSTPPLSGTSAPGTVVTVYEGDTVLCTTTTNDVGAWTCTPAQPLEDGPHTVTGTATDSEGRTSEPSAPSEFIIDTQEPDTRISRTPPSRGGNRTATFEYGASEEDVTYECSLNGGPFEPCRDSYDVGEGQHTLRVRATDRAGNVDSTPAAYSWTVELTRAFAGGGCSTAPAASWLALLGLLGLRRRKRG

SEQ ID NO: 16790 - protein, 1205 aa, Myxococcus xanthus
MDEGLLSGEEVALLREDALRLRRGPLELLRERGRLSEDSLVALRGELASESTDPSVGRPLEAATLTPVTPGVSPPPAVEPDGPTFPVPDWDRYQPVRFLGQGGMGRVFLAYDPMLRRNVALKFVRGDDPELARRFLSEARAQARVRHERVCEVYEVGEVRGRGYIAMRFVDGQSLGQLARSLTLEQKVLVLRQAAEGVHAAHGAGLIHRDIKPGNILVERTEDGGLAPFVMDFGLARDWREEGAAPNAVQGTPHYMAPEQARGEVSRLDRRADIYALGATLYSLLTGRPPFTGATEAEVITRLQHEEPAPPRALDADIPSDLEAIVLKCLEKQRPARYDSARALAEDLERFLEGEPVLARQGLGYRLRRKARKHRVALTLGSAALTMVLLALIQAGIARGEVAERERLTRRFTERVERIEASARYSALSRLHDTREDRRELRASMDALEAEVREAGPHALGPGQYALGRALLVLDERDSARKRLEAAWAQGYREPRVAWALAQVLGDLYQERLLLDVERRSPEQREVRRKELEQNYRDPALAYLRQAEGPDVPVPPLYVKALFAFYEGRHEEALTHLEAMGRAQPWFYEAPLLQGDVLLARATQRWHQGDKAGSQEDLDAGRRAYASAVATAESQPMGHYVLARLELAALVMELYGEGNVLPHYERGVEAATRALTTAPDHHRSLVVLSRLHRRLAEQRTSQGREDAEPLLEKSIHAAREALALAPPSDRVALELAITHRLWARYRQERGQDPSEQLRLSIEAFERLRPEERDYAFHANLGLTYQVWADAEAERGVDPLEHQGKAIDAYLEAIRVRENQADAWINLGNALRRRASNPRATDAAGDLTRARDALAKALALNPGNVVASFRGAEISEQLARWRWSHGEPFEADLEQALALFRQGLGINAKLPPLHNGLGAALLWQAEQRWEEGGDPEPLLQQAQAAFEEARTLAPRQVYAHNNLGEVWTLSATFQSARRENPGPSGRAAVEAYRQALSLQPQDADLWANLGRVQTLLATWSLETGGDPRAELAKAEESLARATTLNPRQGHTWRNMGEARALKARWLAHRGAAQESDFELASQAFQQALSLEPRRHDYRLATARFQLAWAAWRQQRNEDAAPLLNQGLALVAEVLADRPRWARAQALRGGGLLALAETRASSEQRQAWRIEGQEVLRQALARNPHLESEWRGRLGAAREPLAGPPTP

SEQ ID NO: 16791 - protein, 245 aa, Myxococcus xanthus
MFLSLDTSTLTLSLALVERAPDGALRTLEHVVVGPPRKQSELLPGIVGELLERHGATLPALEGLVVGLGPGSFTGLRIGLATVKSLAYATKLKVAGASSLAAVALEGPEGVPLYCLAVARKDDLYLGAYVRQGGTVEPLEPETAMSPAEVAARMAAEPRAVALGPALVDYRAALESQGVAPHRLLAAPTFPSAVALAQLARFPEAQSLEALFAMEPHYVRASEPERNPKFPPLPGPAPTARLKED

SEQ ID NO: 16792 - protein, 72 aa, Myxococcus xanthus
MRLNVKVDRAEPSKVAIVGAAMTAPVGAFVLQGMPSAGDPVKAMQDLQSLMDKGLITPEEFEVKKAQILARI

SEQ ID NO: 16793 - protein, 170 aa, Myxococcus xanthus
MLPFLLFSLVGLGAAGYFFYSHAQTQRLREHGTAGEATILRMDRTSMQINRSYVYDFLLEFKVPGLPTYRRQHRSRAHDWKAFILEPGVRLKVKIDPNDPQRFVVLGPVDQQRPQSIQALVAAATGFTEVRTLAAPDPVKALKDLQSMLDNELITQDEYAQKKAEILARL

SEQ ID NO: 16794 - protein, 116 aa, Myxococcus xanthus
MAIITVLINKSGNLSYIPNNKVRHGDTVRFSIEMIGAASDVTVNPPACLDSTASFNLNNTSLAAAQREDPVSDGAAVGSYPFTVVTGGSPEARSHGLELETKNGNLDVTTDPPKEY

SEQ ID NO: 16795 - protein, 107 aa, Myxococcus xanthus
MKSGNLVYEPNNKVRRGQPVRFVLDQINGPLWAKVNPPACLVATNPVTLDRTSAAPPIYEDPVSESAAFMTYGFTVEVPPVPEKPHLGGEAETKNGNLDVTTDPPEL

SEQ ID NO: 16796 - protein, 529 aa, Myxococcus xanthus
MSTTAGRAQAGQSPVALSVPALTIVSHPQPQRIGERLLLEVLASQGRTAALSRNAPDFSRPGGLMALPLGDPFLSRKPVEFEPGPRGGLRMLVPEDGTQVRVANEPVVGGREFSREELSDGVPLVLADRVVLLLHLASSFRQPGVLDLGIVGHGEGIHRVREDIIRVADLAVPVLILGETGTGKELVARAIHTSGPRRAGPFVSVNLGALAKELVAAELFGAQRGAYTGASRDREGFFRAAEGGTLFLDEVGEAPPEVQAALLRVLETGEIYPVGGHTPVPVDVRLVSATDAHLEARIQERTFKAPLLHRLAGFEILVPPLRERREDVGLLFLHFSRQELEAMGEGGQLTTSDPRAEPWLPAALAVQLVRHAWSGNIRQLRNVTRQLVIGSRGTPGLRADARLEQVLDADAQPVPGRPLTVRTGEEAGDGAKAPRRKPADVGEQELLEALRASSWDLKATADWLGIPRPSVYVLIDKSSLLRTARDLSPEEITRCFHECEGDLDRMVQRLEVSKRALQRRVRELGLSGG

SEQ ID NO: 16797 - protein, 281 aa, Myxococcus xanthus
MDDALLEGMRQSDEVNRLMPGLPPRHTRLMLAPDADLQGDQHPVTQQVVDLLRQPRALGEVLDLAPATDLEVLNVLTTLMQRGVARAADGDGVEAASGELLGAAEVHALRGRILRTRAPAKVATAKIFVCGSGASAARRVLSRMPGMEALSAEPTAVKSGFGTLGRLVLSEVLRLDFCVLPPAEAARPLWRPFTAGAMGALLMDVAEPSVRLAHYLAWEVRMPVVVVGAEVPAALQGAPAGALGATDDLADALRSLLVQALNPAPTLPGVPQVQRAAASIV

SEQ ID NO: 16798 - protein, 507 aa, Myxococcus xanthus
MLLAVDRALERASLRRERTQLRDENLEFARFHNLHQRCLELLSHPDLEWLQERLTSELAAICDAQSAALWVVDDRGDLVLRAYRGLLDRQFLAEKMSPEGPLSGRLREAQPWLARDERSSVMYVPLVASGEVVGLAQLSDPLSGDFRPEHSRDARLLGDFAAVGLKNGRKMLALQRLGLRDRETAAYNLSYFTDYASKEIYKARRYGRTFSLLTFSIDNLPLVRVRQGAADAKKAVRGIIKALSKIIRDSDVIAKASDQEFYLLLPETDFFGALMFVRRAVAAVREEPEAMEVDQRLPLAMVGGASTFPKDGEDFDELVHRCRRRMDERRASLQRRLMLDGLPFWDEVDLLLGTPNSPRLPVDERSEPSRRGKVSDVLFDELQAEIAREMMRDPGSRGLLYVGGPEIRTDLNIAAGLESAPPDLASRIYLLGRRVDLESHPALTPVFLEGDDRIARHEFILWLSENAAYALIQRRGHGATWGFHTSDTAVVDGLISKLQAEYDLQPY

SEQ ID NO: 16799 - protein, 210 aa, Myxococcus xanthus
MCGNGLRCAVKFLVDDSGQTPGHINVETGAGVLTCYPSYGEGGVVAVDISMGPARLVAPNLPSGATGQPFLDALVPGHPPLRAYAVSMGNPHMVLLDQPLEDASRLGPLLEHHPSFPDRTNVEFVRVDSDGLTVVVWERGCGLTQACGTGACASAVAAVLAKRLPADAWLRVTLPGGDLSIRVPADLSDIRLRGPVAFVFEGVVATPSGR

SEQ ID NO: 16800 - protein, 443 aa, Myxococcus xanthus
RAEIEGKLSDAVSRSDAQRAELEAQLAEAVARSNAQRSELEAQLAEAVSRSDALRVEAAQQFAEAAARTEAERTALEARLAEVAVNADAQRGALEAQLADAVAGSEAQRGELEARLAEAVAHAEAQRAESETRLADLNARFEAQQAELESRLAEASANLNAQLAEASDRAARLSDTADRAQADRATLESHVAELTSQLDVLRADLTAATERAATLQSAQERLARADSDRERLQSDLSVARAARVRLEGRVTALEAASTDAVRILDAERAERTRLSQALEVARQQLQQHDGSAAGQLALLQTERSQLDEQLRGLETQLQSQKARVDALEAERTELLSTVESLKVSSQPEDVLEMAAEMELLQSLVEDLQQKLADREAELAAAKRPASRADSFALLDAPEPARNELVPPAGTEQGAKAPARRPRGAVPALDLPPQTSPTKPDERE

SEQ ID NO: 16801 - protein, 344 aa, Myxococcus xanthus
MRDDLTIGVVGATGVVGREVLAALYAQDVPAEQVRVFGSERSKGMEVEYGEDSLEVEQATPDAFRGVKLVLLATPAEASRTLAPAAQAAGAWVVDASSAFRGDGNVPMVLPGFNTDVLGAGFTFKGRIVCLPGAVTTAAVHVVEPLRKAFGVARAQVTALMAASSAGVRGVAELEKQTADLLSGREPEPHAFPHRVGFNLVPQVGGFMVNSPWTEEEGGWTLEAARLFSSKGDVPVIAGTAVQVPTFYGHGLTLNVQLKKAGPVEQVRAALKTSGALKVLDVPGERVYPMPMLVTSDPAVHVGRVRAFPQAPEWVTLFASVDNASRGAALNLVEAGLRLAERPA

SEQ ID NO: 16802 - protein, 225 aa, Myxococcus xanthus
MTPLRKRVAERLIQAQSTAAMLTTFNEVDMGEVMALRKKYNDKFQQKHGVKLGFMSFFIRASVEALKAFPQINAEIDGEDVIFKHYYDIGVAVSGSRGLVVPVVRNADKQGLAELEKSVGELGTKARNDKLALADLQGGTFTITNGGIFGSMLSTPILNPPQTGILGMHNIVERPVARDGQVVIRPIMYIALTYDHRLVDGREAVQFLVRVKECIEDPERLLLDV

SEQ ID NO: 16803 - protein, 68 aa, Myxococcus xanthus
MATGTVKWFNDAKGFGFITQDGGGEDVFCHHTAINMDGFRTLAEGQKVEFEVTRGPKGLQAQNVRAAG

SEQ ID NO: 16804 - protein, 207 aa, Myxococcus xanthus
ANMLTALLTEEPRIEVVGRAGDGNRAVQLARLLRPDVITMDLLLPGLDGPGAIAAIMSQSPARILVVSAVAEQRGVDLGFQAMSAGALELIGKPNVTNAEELRRWGKELAHSVCLMAEVPVISRRPRAATAPPPPTGARVDIFGVVASTGGPPALADVLSKLPRSLPVPLLIAQHITVGFTQGMVRWLSQVTPLPVSIAKDGERLEP

SEQ ID NO: 16805 - protein, 573 aa, Myxococcus xanthus
MVAATGGLAAVAAPVPSAEPVLVPDALPESAYAGWRVSSWQVTALMREVERLREVRLRVEERGRELERVAVLLAKQGLLAETAEARTALSGTARSLRTDGEETSDIVDALEDGLKAITTRPVRTILDPLQRMVRDLSRQLGKEARLSVVGAEVSLDRRLLEKLQGSLVHLLRNAVDHGLELPADRERAGKHHEGALTLRVEQQGNLLYLEASDDGAGIDVEVVRRLAEQRGVVTAEETVRLNENQLRDLIFRSGFSTRTDVTDTSGRGVGLDAVRASVEALQGRIEVASTPGQGTRFMLTLPTDLGSSPVLVVRVLEQLVGLPMLAVEATQLARAESLRLGKRRAHLEYQGQLLSVVDLGARLGLRALAPPAEGQPLLIVQSGGKRVALVVDAVVGDRDLVIRPLPSEVRDVPAWQGAATLSRGELLLICRPDWLVTETVQVQVSAQRRALVVDDSLTARALHRAMLEAGGFTVHLAASGARALDRLQSDTYDVVICDLDMEEMDGIQLIAKLRERPETASLPVILVSAHDSSVARERGLKAGADGYLSKRECAAGRLLAEVLDVMSRRGSRA

SEQ ID NO: 16806 - protein, 182 aa, Myxococcus xanthus
MKVTPRTLEAAQEAEALELLERRASRLREQGENTVEEAVHWIAEFPLGEERYALSLESLRAALPLKMVSPVPLSAPHVVGVLRFQGQVLAALSLASLLGGHGWRQDPAVLLVVDRGDGELCALDCEAIPRPTTLPMSAVEAARVRAEGAVMEVFTQDRQLIHLIDLKRLFSATRGTGARHAR

SEQ ID NO: 16807 - protein, 413 aa, Myxococcus xanthus
  unsure (1)..(413): unsure at all Xaa locations
MSGALDPRLLARAREVVAGITGFRNDAIASEAVDRVVRAELARGRTAPDLLGELLHPVSHLATALVKAILVGETYFFRHPEHFRFISHEAVPAALQRGALALRGWSAGCASGEEAYSLAACLQASLPHGFPVEVLGTDIHEASLEAARRATYGTWSRRESAPRLFPLYSETGEREVTILPPVRRITTFAQANLLAPLPERFGRFDFILCRNVLTYFTPAARDAAITLLSRTLNPGGWLFLGAVEVDRVPAGMVREGPPELQAFRLLTQEELNARAAAASRAAALARPVAAPSRRPVAPLMPAPAREVPVVPSPPXTLLHLNALERIEEGDEVGASSVLEALVRQAPDYLPGLLELALLRERSGAREGAVPLMRALRSRAERLPPDQLVEGPEALPARFYQASADAYLNQGALE

SEQ ID NO: 16808 - protein, 230 aa, Myxococcus xanthus
MDGDEVLQRMKADPATADIPVIIISSEKSRAEACLGLGAETFLAKPFRADELLQTVGEAMTSAWQRARTGSLLVLRVTVGELEFAIPLDAVREVLLHPATRPLPTGPAYLREYVEVRGAALCVLDVARRLGVEHKLTRVERMLVVIEAEGVSLALAVDTVKDPEEYAAADIDRRERVGGADHGPLREGLIGMLRSGGRSLPILDPRVFIARGLLRELPAMLEAAEAGRNA

SEQ ID NO: 16809 - protein, 103 aa, Myxococcus xanthus
MNLKVSTVEADDATRGLQILRLVPVSLVIADINMPGMDGITFVKEVRASAMPQVRSVPILLLTAEKNVDLRQRGTEAGANAFIQKPVSHHELTETVRQFLTKA

SEQ ID NO: 16810 - protein, 272 aa, Myxococcus xanthus
MLLQGKKLLITGVLTPQSLAYGIAEHALAQGAEVLLTGFGRAKSLTERSAKRLKPGMEVLELDVTNSAHFPALTDALRQRWDRVDGVLHSIAFAPEDALGGNFLNTPWESVQTAFRISTFSLKELSVACLPLMTQGGSIVTLDFDNRVAWPIYDWMGVCKAALESTVRYLARDLGPKGIRVNALAAGPLSTIAAKGIPGFKALERGWGQQAPLGWSAKDSHDMVARTACALLSDWLPSTTGEMIHVDGGYHAIGAPPVTPDADELPPKPAGE

SEQ ID NO: 16811 - protein, 299 aa, Myxococcus xanthus
MRLTLVGLLLFASTALGQTVTFSASAEILQNDQIVVSQENCGLDRTVNWTRVAGNCDVLHLWLSNESSCTGTPGAGDLSLADIPVNDTRLTGTVTFNASDALVADGAKCESQTSTKTFRLCATTKRLGTLGGCDDSFVSVGTPSISFIYDPEPPAVPETPSVTGLDAALSVSVKVPSDAVSMEVQVLQSVPGEDGGVGAGEVISKKRQVSSNAVFRMDQGLENGVEYAVQAIAIDRAGNQSEPSPAATGTPVASNGFYQGYLGAGGAETGGCAAAGGGITGCAMLASLGVWLSSRRKRS

SEQ ID NO: 16812 - protein, 981 aa, Myxococcus xanthus
VLWEQELANHLPGPGEHRRRVRVAQGREAVQVHVQQHPAGRVQHVAHGVAGGRAAVGLRRPVHGGHRHQPVRPAPAVHVGVPREGATGAGAGNQQRVPHQPRLHGREDVVVVAHVQRPAGMFIQRAQTGSPVRHGRGGPGHHGVQVPVQRHQQGGALRVTQGAGPGGEGEPVRVEHVGVSGATSPAQAQSDDAGQAQVPRGVVFRFHCVGNPPARQAFAPAARPPSVGCPAPFHERSPALPAGIRRRMRHVLTAALLLASASSSAQEQKPLTMSKTQRSQDPFLRQFSETRRFMSGRPGGVRISPDEKSILFLRTQPTSNVQTLYAFDVESGQTQELLTPEAILKGAEETLTPEEKDRRERMRVSARGFTSYQVSEDGNRLLVPLSGRLYVVDRASGKVTELKTGPGTLDPRFSPDGKQVSYVREHDVYRIDVAANREQRVTKGGTEAKSHGVAEFVAQEEMGRFTGYWWSPDAKSIAYTEADTTEVEKLTIVDVMHPERGGEDFAYPRPGKANAKVRLGITPVTGGKTVWAQWDAAKYPYLATVTWPKGGPLTALVQNREQTEQKLLAVDPRTGKSRELLTEQDAAWLNLEQVFPLWLEDGSGFLWYTERNGGPEVELRKADGALVRTLVKPDAGFRSLARYIQKDDTLYFNGGPNPTQSHLWRVKAGGAPEKVTTGLDIESGSVSKSGGLMVMNGQGLKSMPKVQVVRGDGTTVGELPSVAKEPPYTPNVEQRQVGPERFWTSLVRPRDFKPGKKLPVIVEVYGGPTTTVVHKSMAAHLMSQWVADQGFLVVKIDGRGTPLRGAKWEREVKGDFSGVTLEDQVAALQALAKEVPELDLSRVGISGWSFGGYMSALAVLKRPDVFKAGVAGAPVVDWLDYDTHYTERYLGVPQQSPEAYEKSSLLTYAKQDKPMGKLLLIHGTADDNVYFFHTLKLSDALFRAGKPHDLLPLSGLTHMVPDPLVTERQWERVMDHFKRNL

SEQ ID NO: 16813 - protein, 207 aa, Myxococcus xanthus
ETEDDAPRHLRLAGIIRLGLGGGRGPRDAYVFDPHRLALPAWACALGDTEGPALLVTLDRHLDTVMPRAPAAVPDRTAGLRALDEHARWALDVRNYDHILAAMEAGLVGDALLIARARPRGAFTGDTYVDSRGRPHRLVAVPTVDRAAEAYSRPAPGDAVRDVLDAAGRVLLDVDLDCFTSLSDADPTTVLPWPRQVIREFLLPEDS

SEQ ID NO: 16814 - protein, 171 aa, Myxococcus xanthus
MDLLAPEEIARIERENAGGLPASAILKIFRPRGVRLSEATFRKYVQAGLLPRSRRVGRKGKHQGSVGLYPVEAVRRINVIKKMMSEGHTLEDIKRSYVFHSNYIDQLERDLAGLLNGFQEELGDRAFGGEHRRTLEAQLATLRQRAQDLVRDVARLGSAVTARADETIRSQ

SEQ ID NO: 16815 - protein, 163 aa, Myxococcus xanthus
MSEVKQLQEEGGDQESDQAQERRRSKTMSRKEMARDLRRRRLTGQVDPEEADLLKQMDDTRPRTRADCINGPRPCNFVSCKHNLYLDVNPETGSIKLNFPDKEIWELEHTCALDVAEKGGITLEEVGEIMNLTRERIRQVETRGLMKLREATEAEPPVSARKP

SEQ ID NO: 16816 - protein, 388 aa, Myxococcus xanthus
MVRASAKNFRHVSVVVDPDDYPAVLAELEQQKAVSEDTRRRLMRKAFAHTAAYDASISAWLSAQAGEPFPGELSLAFQKSQDLRYGENPHQRGAFYREHAAPQEPTVAFAKVLQGKELSYNNILDLDAALGLLLEFPEAPAAVIIKHNTPCGVAVDAALVKAYRTARAVDEVSAFGGIVALNREVDAATAQAMAETFLEAVIAPSYSPEALQVLATKKNLRLLEAGPALASPQARPRAQLDARSVSGGMLLMDRDSVEPPLSWKVVSKRAPTPEEEQAMRFAWKVCKHVKSNAIVFASGDQLLAQGGGQTNRVDSVRIAMQRGGAALRGSAVASDAFFPFRDGLDEAARAGATCVVQPGGSVRDAELIAAADEHGMAMVLTGVRHFRH

SEQ ID NO: 16817 - protein, 946 aa, Myxococcus xanthus
MRIVCQKCAAAYAIDDKLITAKGVRAQCPRCRNLQLVRRDPSAVPAAGAPAPASQPAAPVTLTPVSGAAPADDLFGDFGAPPPAAPAPGAAPAPKPARGEGRSGSDLFGDFGAMPSPAPASAPPVDPFASVGMPASGGGGAAGAEDPLLDFLGPPPSAPQGLESQPSHPAKPAAAKPATSGCRVCQKPLTDSFDQALGICDDCRQPGSARAPAGTSRPAAPGGNSDLLPPMADLGGGSASVAQASEPAPGAEPRSGARVPISTDIIPDMGPEPRSGLRASSPQLGAEPRSGSRSAPVLVTDGRSRGGKGGLVAGLVGLVVVGGGVGGYFLYQQQQEASRRQAGPPPVAAIPDAVKAVLPRWKLKYLEILGTSAERLAQGQQQLARDERFAYAEAEESFQQALVLDPTSDAAIAGYVQALALGRGARMDDATFQEARALLSAAESRSGRTAPLLLAHANLLLARSGQPEQARPLAEELLARAELADAQKAEAHLVLGRTWLSSSRELARSHFDSAQKLSPDIKRLHYYRALAHASGGEYSAALDTLRKRLETSPKDWESLALTARIYQEVGEPAEARKLYEARVKAEPGELRALLPLAMLRYQAEGNAAGAVRDLRALMKNRARYDEPEVAEVLVHLAAAERTAGSQDAAVKSAEEALQLVKGLPEAHLQLFLVALGRRDAEKARTHLPGFRGQLEDGALEKVLEGRLLLLEKKPLEALEGFQEAVKLDARRLDAQLLAGVAAASAKRRDDAFRALHQALQSDPLRLEPRPATSAYWLRPRETVEGVEGAILALSEGPEDPSPLLYEGLLRFHQHQFDAAERHLRSVLEVDANNAGALAYRSLIALQRGALADARRLGERSAAAGRQMPVSHLAHGLALADARQVEPAKRALRDALALAPTLLSAQARLAQLESAQGKDVARDTLVKVVGLDPAYLPAKRMLYLLER

SEQ ID NO: 16818 - protein, 294 aa, Myxococcus xanthus
MAAAEAYAVAQGRIVVKADGLAAGKGVIVAHDVEAARAAVRAVGAMGVAGQTMVLEELLEGEEVSAMALCDGERYAMLPLSQDHKRVGEGDTGPNTGGMGAYSPAPFLSAAQLAEVGERVVAPTLAVLRRRGIPFRGVLYAGLMLTRGGPKVLEFNARFGDPETQVLMMQLGEDLLPLLDACARGALVPRTLVSALGASVGVVLAARGYPDAPEKGQRIEGLDAVPPDATVFLAGAEARDGGVVTAGGRVLTVCARGEDLAQARERAYAAVATVRFEGMHFRRDIGARGMKAAP

SEQ ID NO: 16819 - protein, 341 aa, Myxococcus xanthus
MQFLRGTDVLLGSSVTLVDMARLLAYLAPHFLMMALPIAFLLAILLGLGRLGEDRELVALQALGIGPVRLLAAPMGIAVALSVLMLVITSTAQPWGLTGLKVLVSEVIRKNAVGDVKSGVFYEDLSNLTLYAEQVSADGKWTNVLLHDDREANSPLLVLAQRGQVGTSTSGEVLRFALEAGEVHRSAGRETEEYSIIRFDQAEISVGVGASMGKRSRFSYSREELTPGELMEAAREAEAQGEDARMYRMALHSRLGNALAPIAFALLGTPLAMGRRQSGRAWGYLLTLGGYVLYYLLSRVFEQMGQKGQLPAGLAGQMANLVFVAVGLVALYRVSRSGTVK

SEQ ID NO: 16820 - protein, 490 aa, Myxococcus xanthus
MWLPELRGHVEPLMDFYARLVGPENARRAVESSPLLPLLFADLENGTGSVVDPDEGFGFFLLPEFDGVVTLLGITEPEAALKAVADELERAGHGVMPQPDGSATVEPASGGPPMLLFEDRGYLYLAVPEGLEEPDEGESQQAQVLAIPDAEVARQAVRSLTGPGISEDVLLTELRGKVASGSVYLFSGLQPGVAPDEEGTQPIRGFAASLAVKPERMDLDGFLSSSTPLFQGARAPASALLKDAELGPIAAAQISVPPEELARLAFGAPGSERRERMVASWRREGLDVEALLKALRGDVVLRAYFDIPAFFRNFIRNKRPDIKGSIVFEAGLMESEPVRALVQKQLEDSVLRYTTQQEANGTLFRTRIREHPVELRITPERASLLAGELLQGRPRGDVGAELRERFGGEAFSSGHVSVMVDLGRLRADLRAAEKVPGVPNMLLGATKALSGALLDRITPLDSGFLDFSPVEGGGRLKGRLSLRAEQEASR

SEQ ID NO: 16821 - protein, 178 aa, Myxococcus xanthus
MFPVEGMRWRLTDVVERTFDGEGKTSVRQLPEAEYDLGVAVTAFRIRPGRPEQMRASELREQIVARRDVGLATKQFELALHNRFAYPMAAFPAALLGVGLALRANRRGHLTAAIIEGLLTAVAMWGLMMVCRTLVLTERLSPGVAAWTPTVLLGLIAGAVWLQREGRLHLPRRSLLVR

SEQ ID NO: 16822 - protein, 359 aa, Myxococcus xanthus
MPSDTSANLYDLTRPALGALLSGWGFGPYHRDQLWTALYRRHATTFDELDGLKPELLRMLREHTRLGQLATHHESFSSDGFTHKLLLRLDDGQTIETVLMRFKGRATVCISTQAGCAMGCVFCATGQMGLSRHLTPGEIVGQILHVNRILRASGETLRNVVLMGMGEPLHNYEHTMSAVDVLVDALGLAMGPRFITLSTVGVVPGIRRLADEERPIHLAVSLHGATDAERAALVPAGRRWPLDELMDACRYYSEKRKRRIFFEWTLISGRNDTAEHAHTLGQLLRGMDAHVNVIPLNPTVGYDGGPSRPESVRAFQDVLATYDVPSTVRQRRGIDIDAGCGQLKATVERRSRRSLPTSA

SEQ ID NO: 16823 - protein, 127 aa, Myxococcus xanthus
MLSIQEHATVDEASSELLDFVLEPYNWLSLPRTGMDPAAWPGQNTLYQRRVGSLRICASVDVAATLDVFLHIAFRAPGLTPVKAADHLESFLKQRLPLTPNSEWQVEVDERRWIHFSRRYAGPHLKA

SEQ ID NO: 16824 - protein, 300 aa, Myxococcus xanthus
MHLGNIRSALLGWLQARAAHGRFLLRIEDLDRARCKPQYVDDLLRDMEWLGLDWDEQPVFQSQRDGLYRDAQARLEQAGRVYPCFCTRAEIARAASAPHGLSDEGPRYPGTCAHLTREQISERARTRPPAYRFRAVPGEVRFVDGLQGSYSQDVDAVVGDFVVRRNDGVASYQLAVVVDDAATDITHVLRGDDLLSSTPRQLQLYAALSLRAPDFLHVPLVLGEDGKRLAKREGAFALAELRERGVAPERVLGLLASWSGWGDGGPLTLAELVHSFRPERLPRTPIVAGEAALREALGLG

SEQ ID NO: 16825 - protein, 198 aa, Myxococcus xanthus
MLLSSVVGTALRAGGAVVGATGSAVAGAASGGGQAAQAFGLDANDALGPINRRLQAEGKPTITANQLQAATSEVLSTALRTGNLDQEVLVTSIADNTRLSRQDAQEIAGRVSGQFTAFQGKVGQVGEQVQQGALQAAEPTSRVFWGIFASLLLGLISAMLGATVGVSRRQRIAAEGAVITTPPTRPTEPPLPRREVYP
